United States Patent 12,415,844 (BCMA SPECIFIC VCAR COMPOSITIONS AND METHODS FOR USE) - sequence listing, part 4

SEQ ID NO: 15495 - protein, 500 aa, Homo Sapiens
MATVIPGDLSEVRDTQKVPSGKRKRGETKPRKNFPCQLCDKAFNSVEKLKVHSYSHTGERPYKCIQQDCTKAFVSKYKLQRHMATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPPQTQDLQDPANTIGLGSLHSLSAAFTSSLSTSTTLPRFHQAFQ

SEQ ID NO: 15496 - protein, 463 aa, Homo Sapiens
MATFPCQLCGKTFLTLEKFTIHNYSHSRERPYKCVQPDCGKAFVSRYKLMRHMATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 15497 - protein, 496 aa, Homo Sapiens
MTTFFTSVPPWIQDAKQEEEVGWKLVPRPRGREAESQVKCQCEISGTPFSNGEKLRPHSLPQPEQRPYSCPQLHCGKAFASKYKLYRHMATHSAQKPHQCMYCDKMFHRKDHLRNHLQTHDPNKEALHCSECGKNYNTKLGYRRHLAMHAASSGDLSCKVCLQTFESTQALLEHLKAHSRRVAGGAKEKKHPCDHCDRRFYTRKDVRRHLVVHTGRKDFLCQYCAQRFGRKDHLTRHVKKSHSQELLKIKTEPVDMLGLLSCSSTVSVKEELSPVLCMASRDVMGTKAFPGMLPMGMYGAHIPTMPSTGVPHSLVHNTLPMGMSYPLESSPISSPAQLPPKYQLGSTSYLPDKLPKVEVDSFLAELPGSLSLSSAEPQPASPQPAAAAALLDEALLAKSPANLSEALCAANVDFSHLLGFLPLNLPPCNPPGATGGLVMGYSQAEAQPLLTTLQAQPQDSPGAGGPLNFGPLHSLPPVFTSGLSSTTLPRFHQAFQ

SEQ ID NO: 15498 - protein, 350 aa, Homo Sapiens
MEPKRIREGYLVKKGSVFNTWKPMWVVLLEDGIEFYKKKSDNSPKGMIPLKGSTLTSPCQDFGKRMFVFKITTTKQQDHFFQAAFLEERDAWVRDIKKAIKCIEGGQKFARKSTRRSIRLPETIDLGALYLSMKDTEKGIKELNLEKDKKIFNHCFTGNCVIDWLVSNQSVRNRQEGLMIASSLLNEGYLQPAGDMSKSAVDGTAENPFLDNPDAFYYFPDSGFFCEENSSDDDVILKEEFRGVIIKQGCLLKQGHRRKNWKVRKFILREDPAYLHYYDPAGAEDPLGAIHLRGCVVTSVESNSNGRKSEEENLFEIITADEVHYFLQAATPKERTEWIRAIQMASRTGK

SEQ ID NO: 15499 - protein, 673 aa, Homo Sapiens
MDLTKMGMIQLQNPSHPTGLLCKANQMRLAGTLCDVVIMVDSQEFHAHRTVLACTSKMFEILFHRNSQHYTLDFLSPKTFQQILEYAYTATLQAKAEDLDDLLYAAEILEIEYLEEQCLKMLETIQASDDNDTEATMADGGAEEEEDRKARYLKNIFISKHSSEESGYASVAGQSLPGPMVDQSPSVSTSFGLSAMSPTKAAVDSLMTIGQSLLQGTLQPPAGPEEPTLAGGGRHPGVAEVKTEMMQVDEVPSQDSPGAAESSISGGMGDKVEERGKEGPGTPTRSSVITSARELHYGREESAEQVPPPAEAGQAPTGRPEHPAPPPEKHLGIYSVLPNHKADAVLSMPSSVTSGLHVQPALAVSMDFSTYGGLLPQGFIQRELFSKLGELAVGMKSESRTIGEQCSVCGVELPDNEAVEQHRKLHSGMKTYGCELCGKRFLDSLRLRMHLLAHSAGAKAFVCDQCGAQFSKEDALETHRQTHTGTDMAVFCLLCGKRFQAQSALQQHMEVHAGVRSYICSECNRTFPSHTALKRHLRSHTGDHPYECEFCGSCFRDESTLKSHKRIHTGEKPYECNGCGKKFSLKHQLETHYRVHTGEKPFECKLCHQRSRDYSAMIKHLRTHNGASPYQCTICTEYCPSLSSMQKHMKGHKPEEIPPDWRIEKTYLYLCYV

SEQ ID NO: 15500 - protein, 1410 aa, Homo Sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPSTSTTPTATQPTSLGQLAVQSPGQSNQTTNPKLAPSFPSPPAVSIASFVTVKRPGVTGENSNEVAKLVNTLNTIPSLGQSPGPVVVSNNSSAHGSQRTSGPESSMKVTSSIPVFDLQDGGRKICPRCNAQFRVTEALRGHMCYCCPEMVEYQKKGKSLDSEPSVPSAAKPPSPEKTAPVASTPSSTPIPALSPPTKVPEPNENVGDAVQTKLIMLVDDFYYGRDGGKVAQLTNFPKVATSFRCPHCTKRLKNNIRFMNHMKHHVELDQQNGEVDGHTICQHCYRQFSTPFQLQCHLENVHSPYESTTKCKICEWAFESEPLFLQHMKDTHKPGEMPYVCQVCQYRSSLYSEVDVHFRMIHEDTRHLLCPYCLKVFKNGNAFQQHYMRHQKRNVYHCNKCRLQFLFAKDKIEHKLQHHKTFRKPKQLEGLKPGTKVTIRASRGQPRTVPVSSNDTPPSALQEAAPLTSSMDPLPVFLYPPVQRSIQKRAVRKMSVMGRQTCLECSFEIPDFPNHFPTYVHCSLCRYSTCCSRAYANHMINNHVPRKSPKYLALFKNSVSGIKLACTSCTFVTSVGDAMAKHLVFNPSHRSSSILPRGLTWIAHSRHGQTRDRVHDRNVKNMYPPPSFPTNKAATVKSAGATPAEPEELLTPLAPALPSPASTATPPPTPTHPQALALPPLATEGAECLNVDDQDEGSPVTQEPELASGGGGSGGVGKKEQLSVKKLRVVLFALCCNTEQAAEHFRNPQRRIRRWLRRFQASQGENLEGKYLSFEAEEKLAEWVLTQREQQLPVNEETLFQKATKIGRSLEGGFKISYEWAVRFMLRHHLTPHARRAVAHTLPKDVAENAGLFIDFVQRQIHNQDLPLSMIVAIDEISLFLDTEVLSSDDRKENALQTVGTGEPWCDVVLAILADGTVLPTLVFYRGQMDQPANMPDSILLEAKESGYSDDEIMELWSTRVWQKHTACQRSKGMLVMDCHRTHLSEEVLAMLSASSTLPAVVPAGCSSKIQPLDVCIKRTVKNFLHKKWKEQAREMADTACDSDVLLQLVLVWLGEVLGVIGDCPELVQRSFLVASVLPGPDGNINSPTRNADMQEELIASLEEQLKLSGEHSESSTPRPRSSPEETIEPESLHQLFEGESETESFYGFEEADLDLMEI

SEQ ID NO: 15501 - protein, 291 aa, Homo Sapiens
MSCQAFTSADTFIPLNSDASATLPLIMHHSAAECLPVSNHATNVMSTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 15502 - protein, 256 aa, Homo Sapiens
MLWQKPTAPEQAPAPARPYQGVRVKEPVKELLRRKRGHASSGAAPAPTAVVLPHQPLATYTTVGPSCLDMEGSVSAVTEEAALCAGWLSQPTPATLQPLAPWTPYTEYVPHEAVSCPYSADMYVQPVCPSYTVVGPSSVLTYASPPLITNVTTRSSATPAVGPPLEGPEHQAPLTYFPWPQPLSTLPTSTLQYQPPAPALPGPQFVQLPISIPEPVLQDMEDPRRAASSLTIDKLLLEEEDSDAYALNHTLSVEGF

SEQ ID NO: 15503 - protein, 743 aa, Homo Sapiens
MNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSITLTSQPATPTRTIAATPIQTLPQSQSTPKRIDTPSLEEPSDLEELEQFAKTFKQRRIKLGFTQGDVGLAMGKLYGNDFSQTTISRFEALNLSFKNMCKLKPLLEKWLNDAENLSSDSSLSSPSALNSPGIEGLSRRRKKRTSIETNIRVALEKSFLENQKPTSEEITMIADQLNMEKEVIRVWFCNRRQKEKRINPPSSGGTSSSPIKAIFPSPTSLVATTPSLVTSSAATTLTVSPVLPLTSAAVTNLSVTGTSDTTSNNTATVISTAPPASSAVTSPSLSPSPSASASTSEASSASETSTTQTTSTPLSSPLGTSQVMVTASGLQTAAAAALQGAAQLPANASLAAMAAAAGLNPSLMAPSQFAAGGALLSLNPGTLSGALSPALMSNSTLATIQALASGGSLPITSLDATGNLVFANAGGAPNIVTAPLFLNPQNLSLLTSNPVSLVSAAAASAGNSAPVASLHATSTSAESIQNSLFTVASASGAASTTTTASKAQ

SEQ ID NO: 15504 - protein, 479 aa, Homo Sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 15505 - protein, 436 aa, Homo Sapiens
MVNLESMHTDIKMSGDVADSTDARSTLSQVEPGNDRNGLDFNRQIKTEDLSDSLQQTLSHRPCHLSQGPAMMSGNQMSGLNASPCQDMASLHPLQQLVLVPGHLQSVSQFLLSQTQPGQQGLQPNLLPFPQQQSGLLLPQTGPGLASQAFGHPGLPGSSLEPHLEASQHLPVPKHLPSSGGADEPSDLEELEKFAKTFKQRRIKLGFTQGDVGLAMGKLYGNDFSQTTISRFEALNLSFKNMCKLKPLLEKWLNDAESSPSDPSVSTPSSYPSLSEVFGRKRKKRTSIETNIRLTLEKRFQDNPKPSSEEISMIAEQLSMEKEVVRVWFCNRRQKEKRINCPVATPIKPPVYNSRLVSPSGSLGPLSVPPVHSTMPGTVTSSCSPGNNSRPSSPGSGLHASSPTASQNNSKAAVNSASSFNSSGSWYRWNHSTYLH

SEQ ID NO: 15506 - protein, 451 aa, Homo Sapiens
MATTAQYLPRGPGGGAGGTGPLMHPDAAAAAAAAAAAERLHAGAAYREVQKLMHHEWLGAGAGHPVGLAHPQWLPTGGGGGGDWAGGPHLEHGKAGGGGTGRADDGGGGGGFHARLVHQGAAHAGAAWAQGSTAHHLGPAMSPSPGASGGHQPQPLGLYAQAAYPGGGGGGLAGMLAAGGGGAGPGLHHALHEDGHEAQLEPSPPPHLGAHGHAHGHAHAGGLHAAAAHLHPGAGGGGSSVGEHSDEDAPSSDDLEQFAKQFKQRRIKLGFTQADVGLALGTLYGNVFSQTTICRFEALQLSFKNMCKLKPLLNKWLEETDSSSGSPTNLDKIAAQGRKRKKRTSIEVGVKGALESHFLKCPKPSAHEITGLADSLQLEKEVVRVWFCNRRQKEKRMTPAAGAGHPPMDDVYAPGELGPGGGGASPPSAPPPPPPAALHHHHHHTLPGSVQ

SEQ ID NO: 15507 - protein, 443 aa, Homo Sapiens
MATAASNHYSLLTSSASIVHAEPPGGMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 15508 - protein, 500 aa, Homo Sapiens
MATAASNPYLPGNSLLAAGSIVHSDAAGAGGGGGGGGGGGGGGAGGGGGGMQPGSAAVTSGAYRGDPSSVKMVQSDFMQGAMAASNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGQQPPPQSLLYSQPGGFTVNGMLSAPPGPGGGGGGAGGGAQSLVHPGLVRGDTPELAEHHHHHHHHAHPHPPHPHHAQGPPHHGGGGGGAGPGLNSHDPHSDEDTPTSDDLEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGALESHFLKCPKPSAQEITNLADSLQLEKEVVRVWFCNRRQKEKRMTPPGIQQQTPDDVYSQVGTVSADTPPPHHGLQTSVQ

SEQ ID NO: 15509 - protein, 361 aa, Homo Sapiens
MATAASNPYSILSSTSLVHADSAGMQQGSPFRNPQKLLQSDYLQGVPSNGHPLGHHWVTSLSDGGPWSSTLATSPLDQQDVKPGREDLQLGAIIHHRSPHVAHHSPHTNHPNAWGASPAPNPSITSSGQPLNVYSQPGFTVSGMLEHGGLTPPPAAASAQSLHPVLREPPDHGELGSHHCQDHSDEETPTSDELEQFAKQFKQRRIKLGFTQADVGLALGTLYGNVFSQTTICRFEGLQLSFKNMCKLKPLLNKWLEEADSSTGSPTSIDKIAAQGRKRKKRTSIEVSVKGVLETHFLKCPKPAAQEISSLADSLQLEKEVVRVWFCNRRQKEKRMTPPGDQQPHEVYSHTVKTDTSCHDL

SEQ ID NO: 15510 - protein, 419 aa, Homo Sapiens
MMSMNSKQPHFAMHPTLPEHKYPSLHSSSEAIRRACLPTPPLQSNLFASLDETLLARAEALAAVDIAVSQGKSHPFKPDATYHTMNSVPCTSTSTVPLAHHHHHHHHHQALEPGDLLDHISSPSLALMAGAGGAGAAAGGGGAHDGPGGGGGPGGGGGPGGGPGGGGGGGPGGGGGGPGGGLLGGSAHPHPHMHSLGHLSHPAAAAAMNMPSGLPHPGLVAAAAHHGAAAAAAAAAAGQVAAASAAAAVVGAAGLASICDSDTDPRELEAFAERFKQRRIKLGVTQADVGSALANLKIPGVGSLSQSTICRFESLTLSHNNMIALKPILQAWLEEAEGAQREKMNKPELFNGGEKKRKRTSIAAPEKRSLEAYFAVQPRPSSEKIAAIAEKLDLKKNVVRVWFCNQRQKQKRMKFSATY

SEQ ID NO: 15511 - protein, 409 aa, Homo Sapiens
MMMMSLNSKQAFSMPHGGSLHVEPKYSALHSTSPGSSAPIAPSASSPSSSSNAGGGGGGGGGGGGGGGRSSSSSSSGSSGGGGSEAMRRACLPTPPSNIFGGLDESLLARAEALAAVDIVSQSKSHHHHPPHHSPFKPDATYHTMNTIPCTSAASSSSVPISHPSALAGTHHHHHHHHHHHHQPHQALEGELLEHLSPGLALGAMAGPDGAVVSTPAHAPHMATMNPMHQAALSMAHAHGLPSHMGCMSDVDADPRDLEAFAERFKQRRIKLGVTQADVGSALANLKIPGVGSLSQSTICRFESLTLSHNNMIALKPILQAWLEEAEKSHREKLTKPELFNGAEKKRKRTSIAAPEKRSLEAYFAIQPRPSSEKIAAIAEKLDLKKNVVRVWFCNQRQKQKRMKYSAGI

SEQ ID NO: 15512 - protein, 338 aa, Homo Sapiens
MMAMNSKQPFGMHPVLQEPKFSSLHSGSEAMRRVCLPAPQLQGNIFGSFDESLLARAEALAAVDIVSHGKNHPFKPDATYHTMSSVPCTSTSSTVPISHPAALTSHPHHAVHQGLEGDLLEHISPTLSVSGLGAPEHSVMPAQIHPHHLGAMGHLHQAMGMSHPHTVAPHSAMPACLSDVESDPRELEAFAERFKQRRIKLGVTQADVGAALANLKIPGVGSLSQSTICRFESLTLSHNNMIALKPVLQAWLEEAEAAYREKNSKPELFNGSERKRKRTSIAAPEKRSLEAYFAIQPRPSSEKIAAIAEKLDLKKNVVRVWFCNQRQKQKRMKYSAVH

SEQ ID NO: 15513 - protein, 360 aa, Homo Sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 15514 - protein, 359 aa, Homo Sapiens
MAGHLASDFAFSPPPGGGGDGPWGAEPGWVDPLTWLSFQGPPGGPGIGPGVGPGSEVWGIPPCPPPYELCGGMAYCGPQVGVGLVPQGGLETSQPESEAGVGVESNSNGASPEPCTVPPGAVKLEKEKLEQNPEKSQDIKALQKELEQFAKLLKQKRITLGYTQADVGLILGVLFGKVFSQKTICRFEALQLSFKNMCKLRPLLQKWVEEADNNENLQEICKAETLMQARKRKRTSIENRVRGNLENLFLQCPKPTLQISHIAQQLGLEKDVVRVWFCNRRQKGKRSSSDYAQREDFEAAGSPFSGGPVSFPPAPGPHFGTPGYGSPHFTALYSSVPFPEGEVFPPVSVITLGSPMHSN

SEQ ID NO: 15515 - protein, 328 aa, Homo Sapiens
MAGHRPSNHFCPLPGSGGGGPRGPMPLRVDTLTWLSTQAAPGRVMVWPAVRPGICPGPDVWRIPLGPLPHEFRGWIAPCRPRLGASEAGDWLRRPSEGALPGPYIALRSIPKLPPPEDISGILKELQQLAKELRQKRLSLGYSQADVGIAVGALFGKVLSQTTICRFEAQQLSVANMWKLRPLLKKWLKEVEAENLLGLCKMEMILQQSGKWRRASRERRIGNSLEKFFQRCPKPTPQQISHIAGCLQLQKDVVRVWFYNRSKMGSRPTNDASPREIVGTAGPPCPGAPVCFHLGLGLPVDIPHYTRLYSAGVAHSSAPATTLGLLRF

SEQ ID NO: 15516 - protein, 301 aa, Homo Sapiens
MPGISSQILTNAQGQVIGTLPWVVNSASVAAPAPAQSLQVQAVTPQLLLNAQGQVIATLASSPLPPPVAVRKPSTPESPAKSEVQPIQPTPTVPQPAVVIASPAPAAKPSASAPIPITCSETPTVSQLVSKPHTPSLDEDGINLEEIREFAKNFKIRRLSLGLTQTQVGQALTATEGPAYSQSAICRFEKLDITPKSAQKLKPVLEKWLNEAELRNQEGQQNLMEFVGGEPSKKRKRRTSFTPQAIEALNAYFEKNPLPTGQEITEIAKELNYDREVVRVWFCNRRQTLKNTSKLNVFQIP

SEQ ID NO: 15517 - protein, 691 aa, Homo Sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRHTILRSHFFLPQEAQENTIASSLTAKLNPGLLYPARFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 15518 - protein, 468 aa, Homo Sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 15519 - protein, 441 aa, Homo Sapiens
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 15520 - protein, 505 aa, Homo Sapiens
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 15521 - protein, 828 aa, Homo Sapiens
MDSEAFQSARDFLDMNFQSLAMKHMDLKQMELDTAAAKVDELTKQLESLWSDSPAPPGPQAGPPSRPPRYSSSSIPEPFGSRGSPRKAATDGADTPFGRSESAPTLHPYSPLSPKGRPSSPRTPLYLQPDAYGSLDRATSPRPRAFDGAGSSLGRAPSPRPGPGPLRQQGPPTPFDFLGRAGSPRGSPLAEGPQAFFPERGPSPRPPATAYDAPASAFGSSLLGSGGSAFAPPLRAQDDLTLRRRPPKAWNESDLDVAYEKKPSQTASYERLDVFARPASPSLQLLPWRESSLDGLGGTGKDNLTSATLPRNYKVSPLASDRRSDAGSYRRSLGSAGPSGTLPRSWQPVSRIPMPPSSPQPRGAPRQRPIPLSMIFKLQNAFWEHGASRAMLPGSPLFTRAPPPKLQPQPQPQPQPQSQPQPQLPPQPQTQPQTPTPAPQHPQQTWPPVNEGPPKPPTELEPEPEIEGLLTPVLEAGDVDEGPVARPLSPTRLQPALPPEAQSVPELEEVARVLAEIPRPLKRRGSMEQAPAVALPPTHKKQYQQIISRLFHRHGGPGPGGPEPELSPITEGSEARAGPPAPAPPAPIPPPAPSQSSPPEQPQSMEMRSVLRKAGSPRKARRARLNPLVLLLDAALTGELEVVQQAVKEMNDPSQPNEEGITALHNAICGANYSIVDFLITAGANVNSPDSHGWTPLHCAASCNDTVICMALVQHGAAIFATTLSDGATAFEKCDPYREGYADCATYLADVEQSMGLMNSGAVYALWDYSAEFGDELSFREGESVTVLRRDGPEETDWWWAALHGQEGYVPRNYFGLFPRVKPQRSKV

SEQ ID NO: 15522 - protein, 825 aa, Homo Sapiens; identical to SEQ ID NO: 14803

SEQ ID NO: 15523 - protein, 1147 aa, Homo Sapiens
MDSKDESSHVWPTSAEHEQNAAQVHFVPDTGTVAQIVYTDDQVRPPQQVVYTADGASYTSVDGPEHTLVYIHPVEAAQTLFTDPGQVAYVQQDATAQQASLPVHNQVLPSIESVDGSDPLATLQTPLGRLEAKEEEDEDEDEDTEEDEEEDGEDTDLDDWEPDPPRPFDPHDLWCEECNNAHASVCPKHGPLHPIPNRPVLTRARASLPLVLYIDRFLGGVFSKRRIPKRTQFGPVEGPLVRGSELKDCYIHLKVSLDKGDRKERDLHEDLWFELSDETLCNWMMFVRPAQNHLEQNLVAYQYGHHVYYTTIKNVEPKQELKVWYAASYAEFVNQKIHDISEEERKVLREQEKNWPCYECNRRFISSEQLQQHLNSHDEKLDVFSRTRGRGRGRGKRRFGPGRRPGRPPKFIRLEITSENGEKSDDGTQDLLHFPTKEQFDEAEPATLNGLDQPEQTTIPIPQLPQETQSSLEHEPETHTLHLQPQHEESVVPTQSTLTADDMRRAKRIRLELQNAALQHLFIRKSFRPFKCLQCGKAFREKDKLDQHLRFHGREGNCPLTCDLCNKGFISSTSLESHMKLHSDQKTYSCIFCPESFDRLDLLKDHVAIHINDGYFTCPTCKKRFPDFIQVKKHVRSFHSEKIYQCTECDKAFCRPDKLRLHMLRHSDRKDFLCSTCGKQFKRKDKLREHMQRMHNPEREAKKADRISRSKTFKPRITSTDYDSFTFKCRLCMMGFRRRGMLVNHLSKRHPDMKIEEVPELTLPIIKPNRDYFCQYCDKVYKSASKRKAHILKNHPGAELPPSIRKLRPAGPGEPDPMLSTHTQLTGTIATPPVCCPHCSKQYSSKTKMVQHIRKKHPEFAQLSNTIHTPLTTAVISATPAVLTTDSATGETVVTTDLLTQAMTELSQTLTTDYRTPQGDYQRIQYIPVSQSASGLQQPQHIQLQVVQVASATSPHQSQQSTVDVGQLHDPQPYPQHAIQVQHIQVSGQPLSPSAQQAQQGLSPSHIQGSSSTQGQALQQQQQQQQNSSVQHTYLPSAWNSFRGYSSEIQMMTLPPGQFVITDSGVATPVTTGQVKAVTSGHYVLSESQSELEEKQTSALSGGVQVEPPAHSDSLDPQTNSQQQTTQYIITTTTNGNGSSEVHITKP

SEQ ID NO: 15524 - protein, 511 aa, Homo Sapiens
MLKMAEPIASLMIVECRACLRCSPLFLYQREKDRMTENMKECLAQTNAAVGDMVTVVKTEVCSPLRDQEYGQPCSRRPDSSAMEVEPKKLKGKRDLIVPKSFQQVDFWFCESCQEYFVDECPNHGPPVFVSDTPVPVGIPDRAALTIPQGMEVVKDTSGESDVRCVNEVIPKGHIFGPYEGQISTQDKSAGFFSWLIVDKNNRYKSIDGSDETKANWMRYVVISREEREQNLLAFQHSERIYFRACRDIRPGEWLRVWYSEDYMKRLHSMSQETIHRNLARGEKRLQREKSEQVLDNPEDLRGPIHLSVLRQGKSPYKRGFDEGDVHPQAKKKKIDLIFKDVLEASLESAKVEAHQLALSTSLVIRKVPKYQDDAYSQCATTMTHGVQNIGQTQGEGDWKVPQGVSKEPGQLEDEEEEPSSFKADSPAEASLASDPHELPTTSFCPNCIRLKKKVRELQAELDMLKSGKLPEPPVLPPQVLELPEFSDPAGKLVWMRLLSEGRVRSGLCGG

SEQ ID NO: 15525 - protein, 367 aa, Homo Sapiens; identical to SEQ ID NO: 10751

SEQ ID NO: 15526 - protein, 707 aa, Homo Sapiens
MHGAARAPATSVSADCCIPAGLRLGPVPGTFKLGKYLSDRREPGPKKKVRMVRGELVDESGGSPLEWIGLIRAARNSQEQTLEAIADLPGGQIFYRALRDVQPGEELTVWYSNSLAQWFDIPTTATPTHDEKGEERYICWYCWRTFRYPNSLKAHLRFHCVFSGGGGGAFLHHEHAARQGAVPAADGLGLSPKPPAPDFAAPSQAGTLRPHPLGPPPVQACGAREGIKREASSAPSATSPTPGKWGQPKKGKEQLDRALDMSGAARGQGHFLGIVGGSSAGVGSLAFYPGVRSAFKPAGLARAAAAAHGDPYREESSSKQGAGLALGRLLGGGRACGRPGSGENSAAGGAGHHHHHHAHHHHHPKCLLAGDPPPPPPPGLPCSGALRGFPLLSVPPEEASAFKHVERAPPAAAALPGARYAQLPPAPGLPLERCALPPLDPGGLKAYPGGECSHLPAVMPAFTVYNGELLYGSPATTAYYPLKLHFGGLLKYPESISYFSGPAAAALSPAELGSLASIDREIAMHNQQLSEMAAGKGRGRLDSGTLPPAVAAAGGTGGGGSGGSGAGKPKTGHLCLYCGKLYSRKYGLKIHMRTHTGYKPLKCKVCLRPFGDPSNLNKHIRLHAEGNTPYRCEFCGKVLVRRRDLERHVKSRHPGQSLLAKAGDGPGAEPGYPPEPGDPKSDDSDVDVCFTDDQSDPEVGGGGERDL

SEQ ID NO: 15527 - protein, 571 aa, Homo Sapiens
MALPRPSEAVPQDKVCYPPESSPQNLAAYYTPFPSYGHYRNSLATVEEDFQPFRQLEAAASAAPAMPPFPFRMAPPLLSPGLGLQREPLYDLPWYSKLPPWYPIPHVPREVPPFLSSSHEYAGASSEDLGHQIIGGDNESGPCCGPDTLIPPPPADASLLPEGLRTSQLLPCSPSKQSEDGPKPSNQEGKSPARFQFTEEDLHFVLYGVTPSLEHPASLHHAISGLLVPPDSSGSDSLPQTLDKDSLQLPEGLCLMQTVFGEVPHFGVFCSSFIAKGVRFGPFQGKVVNASEVKTYGDNSVMWEIFEDGHLSHFIDGKGGTGNWMSYVNCARFPKEQNLVAVQCQGHIFYESCKEIHQNQELLVWYGDCYEKFLDIPVSLQVTEPGKQPSGPSEESAEGYRCERCGKVFTYKYYRDKHLKYTPCVDKGDRKFPCSLCKRSFEKRDRLRIHILHVHEKHRPHKCSTCGKCFSQSSSLNKHMRVHSGDRPYQCVYCTKRFTASSILRTHIRQHSGEKPFKCKYCGKSFASHAAHDSHVRRSHKEDDGCSCSICGKIFSDQETFYSHMKFHEDY

SEQ ID NO: 15528 - protein, 1507 aa, Homo Sapiens
MPRRRPPASGAAQFPERIATRSPDPIPLCTFQRQPRAAPVQPPCRLFFVTFAGCGHRWRSESKPGWISRSRSGIALRAARPPGSSPPRPAAPRPPPPGGVVAEAPGDVVIPRPRVQPMRVARGGPWTPNPAFREAESWSQIGNQRVSEQLLETSLGNEVSDTEPLSPASAGLRRNPALPPGPFAQNFSWGNQENLPPALGKIANGGGTGAGKAECGYETESHLLEPHEIPLNVNTHKFSDCEFPYEFCTVCFSPFKLLGMSGVEGVWNQHSRSASMHTFLNHSATGIREAGCRKDMPVSEMAEDGSEEIMFIWCEDCSQYHDSECPELGPVVMVKDSFVLSRARSWPASGHVHTQAGQGMRGYEDRDRADPQQLPEAVPAGLVRRLSGQQLPCRSTLTWGRLCHLVAQGRSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLGHLEQAKSLPPGSQSEAAAPEKEQDTPRGEPPAVPESENVATKEQKKKPRRGRKPKVSKAEQPLVIVEDKEPTEQVAEIITEVPPDEPVSATPDERIMELVLGKLATTTTDTSSVPKFTHHQNNTITLKRSLILSSRHGIRRKLIKQLGEHKRVYQCNICSKIFQNSSNLSRHVRSHGDKLFKCEECAKLFSRKESLKQHVSYKHSRNEVDGEYRYRCGTCEKTFRIESALEFHNCRTDDKTFQCEMCFRFFSTNSNLSKHKKKHGDKKFACEVCSKMFYRKDVMLDHQRRHLEGVRRVKREDLEAGGENLVRYKKEPSGCPVCGKVFSCRSNMNKHLLTHGDKKYTCEICGRKFFRVDVLRDHIHVHFKDIALMDDHQREEFIGKIGISSEENDDNSDESADSEPHKYSCKRCQLTFGRGKEYLKHIMEVHKEKGYGCSICNRRFALKATYHAHMVIHRENLPDPNVQKYIHPCEICGRIFNSIGNLERHKLIHTGVKSHACEQCGKSFARKDMLKEHMRVHDNVREYLCAECGKGMKTKHALRHHMKLHKGIKEYECKECHRRFAQKVNMLKHCKRHTGIKDFMCELCGKTFSERNTMETHKLIHTVGKQWTCSVCDKKYVTEYMLQKHVQLTHDKVEAQSCQLCGTKVSTRASMSRHMRRKHPEVLAVRIDDLDHLPETTTIDASSIGIVQPELTLEQEDLAEGKHGKAAKRSHKRKQKPEEEAGAPVPEDATFSEYSEKETEFTGSVGDETNSAVQSIQQVVVTLGDPNVTTPSSSVGLTNITVTPITTAAATQFTNLQPVAVGHLTTPERQLQLDNSILTVTFDTVSGSAMLHNRQNDVQIHPQPEASNPQSVAHFINLTTLVNSITPLGSQLSDQHPLTWRAVPQTDVLPPSQPQAPPQQAAQPQVQAEQQQQQMYSY

SEQ ID NO: 15529 - protein, 1276 aa, Homo Sapiens
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 15530 - protein, 1718 aa, Homo Sapiens
MNQNTTEPVAATETLAEVPEHVLRGLPEEVRLFPSAVDKTRIGVWATKPILKGKKFGPFVGDKKKRSQVKNNVYMWEVYYPNLGWMCIDATDPEKGNWLRYVNWACSGEEQNLFPLEINRAIYYKTLKPIAPGEELLVWYNGEDNPEIAAAIEEERASARSKRSSPKSRKGKKKSQENKNKGNKIQDIQLKTSEPDFTSANMRDSAEGPKEDEEKPSASALEQPATLQEVASQEVPPELATPAPAWEPQPEPDERLEAAACEVNDLGEEEEEEEEEDEEEEEDDDDDELEDEGEEEASMPNENSVKEPEIRCDEKPEDLLEEPKTTSEETLEDCSEVTPAMQIPRTKEEANGDVFETFMFPCQHCERKFTTKQGLERHMHIHISTVNHAFKCKYCGKAFGTQINRRRHERRHEAGLKRKPSQTLQPSEDLADGKASGENVASKDDSSPPSLGPDCLIMNSEKASQDTINSSVVEENGEVKELHPCKYCKKVFGTHTNMRRHQRRVHERHLIPKGVRRKGGLEEPQPPAEQAQATQNVYVPSTEPEEEGEADDVYIMDISSNISENLNYYIDGKIQTNNNTSNCDVIEMESASADLYGINCLLTPVTVEITQNIKTTQVPVTEDLPKEPLGSTNSEAKKRRTASPPALPKIKAETDSDPMVPSCSLSLPLSISTTEAVSFHKEKSVYLSSKLKQLLQTQDKLTPAGISATEIAKLGPVCVSAPASMLPVTSSRFKRRTSSPPSSPQHSPALRDFGKPSDGKAAWTDAGLTSKKSKLESHSDSPAWSLSGRDERETVSPPCFDEYKMSKEWTASSAFSSVCNQQPLDLSSGVKQKAEGTGKTPVQWESVLDLSVHKKHCSDSEGKEFKESHSVQPTCSAVKKRKPTTCMLQKVLLNEYNGIDLPVENPADGTRSPSPCKSLEAQPDPDLGPGSGFPAPTVESTPDVCPSSPALQTPSLSSGQLPPLLIPTDPSSPPPCPPVLTVATPPPPLLPTVPLPAPSSSASPHPCPSPLSNATAQSPLPILSPTVSPSPSPIPPVEPLMSAASPGPPTLSSSSSSSSSSSSFSSSSSSSSPSPPPLSAISSVVSSGDNLEASLPMISFKQEELENEGLKPREEPQSAAEQDVVVQETFNKNFVCNVCESPFLSIKDLTKHLSIHAEEWPFKCEFCVQLFKDKTDLSEHRFLLHGVGNIFVCSVCKKEFAFLCNLQQHQRDLHPDKVCTHHEFESGTLRPQNFTDPSKAHVEHMQSLPEDPLETSKEEEELNDSSEELYTTIKIMASGIKTKDPDVRLGLNQHYPSFKPPPFQYHHRNPMGIGVTATNFTTHNIPQTFTTAIRCTKCGKGVDNMPELHKHILACASASDKKRYTPKKNPVPLKQTVQPKNGVVVLDNSGKNAFRRMGQPKRLNFSVELSKMSSNKLKLNALKKKNQLVQKAILQKNKSAKQKADLKNACESSSHICPYCNREFTYIGSLNKHAAFSCPKKPLSPPKKKVSHSSKKGGHSSPASSDKNSNSNHRRRTADAEIKMQSMQTPLGKTRARSSGPTQVPLPSSSFRSKQNVKFAASVKSKKPSSSSLRNSSPIRMAKITHVEGKKPKAVAKNHSAQLSSKTSRSLHVRVQKSKAVLQSKSTLASKKRTDRFNIKSRERSGGPVTRSLQLAAAADLSENKREDGSAKQELKDFSYSLRLASRCSPPAAPYITRQYRKVKAPAAAQFQGPFFKE

SEQ ID NO: 15531 - protein, 801 aa, Homo Sapiens
MHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLESHMVIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 15532 - protein, 630 aa, Homo Sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHVLQCTAKSSLKESSRSFQCSVCNSSFSSASSFEQHQETCRGDARFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGERPYQCPYCEKGFSKNDGLKMHIRTHTREKPYKCSECSKAFSQKRGLDEHKRTHTGEKPFQCDVCDLAFSLKKMLIRHKMTHNPNRPLAECQFCHKKFTRNDYLKVHMDNIHGVADS

SEQ ID NO: 15533 - protein, 595 aa, Homo Sapiens
MLKPGDPGGSAFLKVDPAYLQHWQQLFPHGGAGPLKGSGAAGLLSAPQPLQPPPPPPPPERAEPPPDSLRPRPASLSSASSTPASSSTSASSASSCAAAAAAAALAGLSALPVSQLPVFAPLAAAAVAAEPLPPKELCLGATSGPGPVKCGGGGGGGGEGRGAPRFRCSAEELDYYLYGQQRMEIIPLNQHTSDPNNRCDMCADNRNGECPMHGPLHSLRRLVGTSSAAAAAPPPELPEWLRDLPREVCLCTSTVPGLAYGICAAQRIQQGTWIGPFQGVLLPPEKVQAGAVRNTQHLWEIYDQDGTLQHFIDGGEPSKSSWMRYIRCARHCGEQNLTVVQYRSNIFYRACIDIPRGTELLVWYNDSYTSFFGIPLQCIAQDENLNVPSTVMEAMCRQDALQPFNKSSKLAPTTQQRSVVFPQTPCSRNFSLLDKSGPIESGFNQINVKNQRVLASPTSTSQLHSEFSDWHLWKCGQCFKTFTQRILLQMHVCTQNPDRPYQCGHCSQSFSQPSELRNHVVTHSSDRPFKCGYCGRAFAGATTLNNHIRTHTGEKPFKCERCERSFTQATQLSRHQRMPNECKPITESPESIEVD

SEQ ID NO: 15534 - protein, 492 aa, Homo Sapiens
MSPERSQEESPEGDTERTERKPMVKDAFKDISIYFTKEEWAEMGDWEKTRYRNVKMNYNALITVGLRATRPAFMCHRRQAIKLQVDDTEDSDEEWTPRQQVKPPWMAFRGEQSKHQKGMPKASFNNESSLRELSGTPNLLNTSDSEQAQKPVSPPGEASTSGQHSRLKLELRRKETEGKMYSLRERKGHAYKEISEPQDDDYLYCEMCQNFFIDSCAAHGPPTFVKDSAVDKGHPNRSALSLPPGLRIGPSGIPQAGLGVWNEASDLPLGLHFGPYEGRITEDEEAANSGYSWLITKGRNCYEYVDGKDKSSANWMRYVNCARDDEEQNLVAFQYHRQIFYRTCRVIRPGCELLVWSGDEYGQELGIRSSIEPAESLGQAVNCWSGMGMSMARNWASSGAASGRKSSWQGENQSQRSIHVPHAVWPFQVKNFSVNMWNAITPLRTSQDHLQENFSNQRIPAQGIRIRSGNILIHAAVMTKPKVKRSKKGPNS

SEQ ID NO: 15535 - protein, 689 aa, Homo Sapiens
MEDTGIQRGIWDGDAKAVQQCLTDIFTSVYTTCDIPENAIFGPCVLSHTSLYDSIAFIALKSTDKRTVPYIFRVDTSAANGSSEGLMWLRLVQSARDKEEQNLEAYIKNGQLFYRSLRRIAKDEELLVWYGKELTELLLLCPSRSHNKMNGSSPYTCLECSQRFQFEFPYVAHLRFRCPKRLHSADISPQDEQGGGVGTKDHGGGGGGGKDQQQQQQEAPLGPGPKFCKAGPLHHYPSPSPESSNPSAAAGGSSAKPSTDFHNLARELENSRGGSSCSPAQSLSSGSGSGGGGGHQEAELSPDGIATGGGKGKRKFPEEAAEGGGGAGLVGGRGRFVERPLPASKEDLVCTPQQYRASGSYFGLEENGRLFAPPSPETGEAKRSAFVEVKKAARAASLQEEGTADGAGVASEDQDAGGGGGSSTPAAASPVGAEKLLAPRPGGPLPSRLEGGSPARGSAFTSVPQLGSAGSTSGGGGTGAGAAGGAGGGQGAASDERKSAFSQPARSFSQLSPLVLGQKLGALEPCHPADGVGPTRLYPAAADPLAVKLQGAADLNGGCGSLPSGGGGLPKQSPFLYATAFWPKSSAAAAAAAAAAAAGPLQLQLPSALTLLPPSFTSLCLPAQNWCAKCNASFRMTSDLVYHMRSHHKKEYAMEPLVKRRREEKLKCPICNESFRERHHLSRHMTSHN

SEQ ID NO: 15536 - protein, 894 aa, Homo Sapiens
MSPEKSQEESPEEDTERTERKPMVKDAFKDISIYFTKEEWAEMGDWEKTRYRNVKRNYNALITIGLRATRPAFMCHRRQAIKLQVDDTEDSDEEWTPRQQVKPPWMALRVEQRKHQKGMPKASFSNESSLKELSRTANLLNASGSEQAQKPVSPSGEASTSGQHSRLKLELRKKETERKMYSLRERKGHAYKEVSEPQDDDYLYCEMCQNFFIDSCAAHGPPTFVKDSAVDKGHPNRSALSLPPGLRIGPSGIPQAGLGVWNEASDLPLGLHFGPYEGRITEDEEAANNGYSWLITKGRNCYEYVDGKDKSWANWMRYVNCARDDEEQNLVAFQYHRQIFYRTCRVIRPGCELLVWYGDEYGQELGIKWGSKWKKELMAGREPKPEIHPCPSCCLAFSSQKFLSQHVERNHSSQNFPGPSARKLLQPENPCPGDQNQEQQYPDPHSRNDKTKGQEIKERSKLLNKRTWQREISRAFSSPPKGQMGSCRVGKRIMEEESRTGQKVNPGNTGKLFVGVGISRIAKVKYGECGQGFSVKSDVITHQRTHTGEKLYVCRECGRGFSWKSHLLIHQRIHTGEKPYVCRECGRGFSWQSVLLTHQRTHTGEKPYVCRECGRGFSRQSVLLTHQRRHTGEKPYVCRECGRGFSRQSVLLTHQRRHTGEKPYVCRECGRGFSWQSVLLTHQRTHTGEKPYVCRECGRGFSWQSVLLTHQRTHTGEKPYVCRECGRGFSNKSHLLRHQRTHTGEKPYVCRECGRGFRDKSHLLRHQRTHTGEKPYVCRECGRGFRDKSNLLSHQRTHTGEKPYVCRECGRGFSNKSHLLRHQRTHTGEKPYVCRECGRGFRNKSHLLRHQRTHTGEKPYVCRECGRGFSDRSSLCYHQRTHTGEKPYVCREDE

SEQ ID NO: 15537 - protein, 417 aa, Homo Sapiens
MGRRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQAVQTDFSSDPLQKVVCFNHDNTLLATGGTDGYVRVWKVPSLEKVLEFKAHEGEIEDLALGPDGKLVTVGRDLKASVWQKDQLVTQLHWQENGPTFSSTPYRYQACRFGQVPDQPAGLRLFTVQIPHKRLRQPPPCYLTAWDGSNFLPLRTKSCGHEVVSCLDVSESGTFLGLGTVTGSVAIYIAFSLQCLYYVREAHGIVVTDVAFLPEKGRGPELLGSHETALFSVAVDSRCQLHLLPSRRSVPVWLLLLLCVGLIIVTILLLQSAFPGFL

SEQ ID NO: 15538 - protein, 226 aa, Homo Sapiens
MEAERRRQAEKPKKGRVGSNLLPERHPATGTPTTTVDSSAPPCRRLPGAGGGRSRFSPQGGQRGRPHSRRRHRTTFSPVQLEQLESAFGRNQYPDIWARESLARDTGLSEARIQVWFQNRRAKQRKQERSLLQPLAHLSPAAFSSFLPESTACPYSYAAPPPPVTCFPHPYSHALPSQPSTGGAFALSHQSEDWYPTLHPAPAGHLPCPPPPPMLPLSLEPSKSWN

SEQ ID NO: 15539 - protein, 737 aa, Homo Sapiens
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQLQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLHE

SEQ ID NO: 15540 - protein, 592 aa, Homo Sapiens
MDPNSILLSPQPQICSHLAEACTEGERSSSPPELDRDSPFPWSQVPSSSPTDPEWFGDEHIQAKRARVETIVRGMCLSPNPLVPGNAQAGVSPRCPKKARERKRKQNLPTPQGLLMPAPAWDQGNRKGGPRVREQLHLLKQQLRHLQEHILQAAKPRDTAQGPGGCGTGKGPLSAKQGNGCGPRPWVVDGDHQQGTSKDLSGAEKHQESEKPSFLPSGAPASLEILRKELTRAVSQAVDSVLQKVLLDPPGHLTQLGRSFQGQVAEGRSEPSPPVGGACKDPLALAALPRRVQLQAGVPVGNLSLAKRLDSPRYPIPPRMTPKPCQDPPANFPLTAPSHIQENQILSQLLGHRYNNGHWSSSPPQDSSSQRHPSSEPALRPWRTTKPQPLVLSQQQCPLPFTSAHLESLPLLPSVKMEQRGLHAVMEALPFSLLHIQEGLNPGHLKKAKLMFFFTRYPSSNLLKVYFPDVQFNRCITSQMIKWFSNFREFYYIQMEKSARQAISDGVTNPKMLVVLRNSELFQALNMHYNKGNDFEVPDCFLEIASLTLQEFFRAVSAGRDSDPSWKKPIYKIISKLDSDIPEIFKSSSYPQ

SEQ ID NO: 15541 - protein, 245 aa, Homo Sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 15542 - protein, 253 aa, Homo Sapiens
MDSAAAAFALDKPALGPGPPPPPPALGPGDCAQARKNFSVSHLLDLEEVAAAGRLAARPGARAEAREGAAREPSGGSSGSEAAPQDGECPSPGRGSAAKRKKKQRRNRTTFNSSQLQALERVFERTHYPDAFVREELARRVNLSEARVQVWFQNRRAKFRRNERAMLASRSASLLKSYSQEAAIEQPVAPRPTALSPDYLSWTASSPYSTVPPYSPGSSGPATPGVNMANSIASLRLKAKEFSLHHSQVPTVN

SEQ ID NO: 15543 - protein, 523 aa, Homo Sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENREQEMRMGDMGPRGAINMGDAFSPAPAGNQGPPPMMGMNMNNRATIPGPPMGPGPAMGPEGAANMGTPMMPDNGAVHNDRFPQGPPSQMGSPMGSRTGSETPQAPMSGVGPVSGGPGGFGRGSQGGNFEGPNKRRRY

SEQ ID NO: 15544 - protein, 328 aa, Homo Sapiens
MDAVLLEHFPGGLDAFPSSYFDEDDFFTDQSSRDPLEDGDELLADEQAEVEFLSHQLHEYCYRDGACLLLQPAPPAAPLALAPPSSGGLGEPDDGGGGGYCCETGAPPGGFPYSPGSPPSCLAYPCAGAAVLSPGARLRGLSGAAAAAARRRRRVRSEAELQQLRQAANVRERRRMQSINDAFEGLRSHIPTLPYEKRLSKVDTLRLAIGYINFLSELVQADLPLRGGGAGGCGGPGGGGRLGGDSPGSQAQKVIICHRGTRSPSPSDPDYGLPPLAGHSLSWTDEKQLKEQNIIRTAKVWTPEDPRKLNSKSSFNNIENEPPFEFVS

SEQ ID NO: 15545 - protein, 322 aa, Homo Sapiens
MADRDSGSEQGGAALGSGGSLGHPGSGSGSGGGGGGGGGGGGSGGGGGGAPGGLQHETQELASKRVDIQNKRFYLDVKQNAKGRFLKIAEVGAGGNKSRLTLSMSVAVEFRDYLGDFIEHYAQLGPSQPPDLAQAQDEPRRALKSEFLVRENRKYYMDLKENQRGRFLRIRQTVNRGPGLGSTQGQTIALPAQGLIEFRDALAKLIDDYGVEEEPAELPEGTSLTVDNKRFFFDVGSNKYGVFMRVSEVKPTYRNSITVPYKVWAKFGHTFCKYSEEMKKIQEKQREKRAACEQLHQQQQQQQEETAAATLLLQGEEEGEED

SEQ ID NO: 15546 - protein, 312 aa, Homo Sapiens
MADGDSGSERGGGGGPCGFQPASRGGGEQETQELASKRLDIQNKRFYLDVKQNAKGRFLKIAEVGAGGSKSRLTLSMAVAAEFRDSLGDFIEHYAQLGPSSPEQLAAGAEEGGGPRRALKSEFLVRENRKYYLDLKENQRGRFLRIRQTVNRGGGGFGAGPGPGGLQSGQTIALPAQGLIEFRDALAKLIDDYGGEDDELAGGPGGGAGGPGGGLYGELPEGTSITVDSKRFFFDVGCNKYGVFLRVSEVKPSYRNAITVPFKAWGKFGGAFCRYADEMKEIQERQRDKLYERRGGGSGGGEESEGEEVDED

SEQ ID NO: 15547 - protein, 347 aa, Homo Sapiens
MERARRRGGGGGRGRGGKNVGGSGLSKSRLYPQAQHSHYPHYAASATPNQAGGAAEIQELASKRVDIQKKRFYLDVKQSSRGRFLKIAEVWIGRGRQDNIRKSKLTLSLSVAAELKDCLGDFIEHYAHLGLKGHRQEHGHSKEQGSRRRQKHSAPSPPVSVGSEEHPHSVLKTDYIERDNRKYYLDLKENQRGRFLRIRQTMMRGTGMIGYFGHSLGQEQTIVLPAQGMIEFRDALVQLIEDYGEGDIEERRGGDDDPLELPEGTSFRVDNKRFYFDVGSNKYGIFLKVSEVRPPYRNTITVPFKAWTRFGENFIKYEEEMRKICNSHKEKRMDGRKASGEEQECLD

SEQ ID NO: 15548 - protein, 462 aa, Homo Sapiens
MASNSSSCPTPGGGHLNGYPVPPYAFFFPPMLGGLSPPGALTTLQHQLPVSGYSTPSPATIETQSSSSEEIVPSPPSPPPLPRIYKPCFVCQDKSSGYHYGVSACEGCKGFFRRSIQKNMVYTCHRDKNCIINKVTRNRCQYCRLQKCFEVGMSKESVRNDRNKKKKEVPKPECSESYTLTPEVGELIEKVRKAHQETFPALCQLGKYTTNNSSEQRVSLDIDLWDKFSELSTKCIIKTVEFAKQLPGFTTLTIADQITLLKAACLDILILRICTRYTPEQDTMTFSDGLTLNRTQMHNAGFGPLTDLVFAFANQLLPLEMDDAETGLLSAICLICGDRQDLEQPDRVDMLQEPLLEALKVYVRKRRPSRPHMFPKMLMKITDLRSISAKGAERVITLKMEIPGSMPPLIQEMLENSEGLDTLSGQPGGGGRDGGGLAPPPGSCSPSLSPSSNRSSPATHSP

SEQ ID NO: 15549 - protein, 455 aa, Homo Sapiens
MTTSGHACPVPAVNGHMTHYPATPYPLLFPPVIGGLSLPPLHGLHGHPPPSGCSTPSPATIETQSTSSEELVPSPPSPLPPPRVYKPCFVCQDKSSGYHYGVSACEGCKGFFRRSIQKNMIYTCHRDKNCVINKVTRNRCQYCRLQKCFEVGMSKESVRNDRNKKKKETSKQECTESYEMTAELDDLTEKIRKAHQETFPSLCQLGKYTTNSSADHRVRLDLGLWDKFSELATKCIIKIVEFAKRLPGFTGLTIADQITLLKAACLDILILRICTRYTPEQDTMTFSDGLTLNRTQMHNAGFGPLTDLVFTFANQLLPLEMDDTETGLLSAICLICGDRQDLEEPTKVDKLQEPLLEALKIYIRKRRPSKPHMFPKILMKITDLRSISAKGAERVITLKMEIPGSMPPLIQEMLENSEGHEPLTPSSSGNTAEHSPSISPSSVENSGVSQSPLVQ

SEQ ID NO: 15550 - protein, 454 aa, Homo Sapiens
MATNKERLFAAGALGPGSGYPGAGFPFAFPGALRGSPPFEMLSPSFRGLGQPDLPKEMASLSVETQSTSSEEMVPSSPSPPPPPRVYKPCFVCNDKSSGYHYGVSSCEGCKGFFRRSIQKNMVYTCHRDKNCIINKVTRNRCQYCRLQKCFEVGMSKEAVRNDRNKKKKEVKEEGSPDSYELSPQLEELITKVSKAHQETFPSLCQLGKYTTNSSADHRVQLDLGLWDKFSELATKCIIKIVEFAKRLPGFTGLSIADQITLLKAACLDILMLRICTRYTPEQDTMTFSDGLTLNRTQMHNAGFGPLTDLVFAFAGQLLPLEMDDTETGLLSAICLICGDRMDLEEPEKVDKLQEPLLEALRLYARRRRPSQPYMFPRMLMKITDLRGISTKGAERAITLKMEIPGPMPPLIREMLENPEMFEDDSSQPGPHPNASSEDEVPGGQGKGGLKSPA

SEQ ID NO: 15551 - protein, 313 aa, Homo Sapiens
MSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 15552 - protein, 346 aa, Homo Sapiens
MHLPGCAPAMADGSFSLAGHLLRSPGGSTSRLHSIEAILGFTKDDGILGTFPAERGARGAKERDRRLGARPACPKAPEEGSEPSPPPAPAPAPEYEAPRPYCPKEPGEARPSPGLPVGPATGEAKLSEEEQPKKKHRRNRTTFTTYQLHELERAFEKSHYPDVYSREELAGKVNLPEVRVQVWFQNRRAKWRRQEKLEVSSMKLQDSPLLSFSRSPPSATLSPLGAGPGSGGGPAGGALPLESWLGPPLPGGGATALQSLPGFGPPAQSLPASYTPPPPPPPFLNSPPLGPGLQPLAPPPPSYPCGPGFGDKFPLDEADPRNSSIAALRLKAKEHIQAIGKPWQAL

SEQ ID NO: 15553 - protein, 184 aa, Homo Sapiens
MFLSPGEGPATEGGGLGPGEEAPKKKHRRNRTTFTTYQLHQLERAFEASHYPDVYSREELAAKVHLPEVRVQVWFQNRRAKWRRQERLESGSGAVAAPRLPEAPALPFARPPAMSLPLEPWLGPGPPAVPGLPRLLGPGPGLQASFGPHAFAPTFADGFALEEASLRLLAKEHAQALDRAWPPA

SEQ ID NO: 15554 - protein, 714 aa, Homo Sapiens
MNTLQGPVSFKDVAVDFTQEEWQQLDPDEKITYRDVMLENYSHLVSVGYDTTKPNVIIKLEQGEEPWIMGGEFPCQHSPEAWRVDDLIERIQENEDKHSRQAACINSKTLTEEKENTFSQIYMETSLVPSSIIAHNCVSCGKNLESISQLISSDGSYARTKPDECNECGKTYHGEKMCEFNQNGDTYSHNEENILQKISILEKPFEYNECMEALDNEAVFIAHKRAYIGEKPYEWNDSGPDFIQMSNFNAYQRSQMEMKPFECSECGKSFCKKSKFIIHQRAHTGEKPYECNVCGKSFSQKGTLTVHRRSHLEEKPYKCNECGKTFCQKLHLTQHLRTHSGEKPYECSECGKTFCQKTHLTLHQRNHSGERPYPCNECGKSFSRKSALSDHQRTHTGEKLYKCNECGKSYYRKSTLITHQRTHTGEKPYQCSECGKFFSRVSYLTIHYRSHLEEKPYECNECGKTFNLNSAFIRHRKVHTEEKSHECSECGKFSQLYLTDHHTAHLEEKPYECNECGKTFLVNSAFDGHQPLPKGEKSYECNVCGKLFNELSYYTEHYRSHSEEKPYGCSECGKTFSHNSSLFRHQRVHTGEKPYECYECGKFFSQKSYLTIHHRIHSGEKPYECSKCGKVFSRMSNLTVHYRSHSGEKPYECNECGKVFSQKSYLTVHYRTHSGEKPYECNECGKKFHHRSAFNSHQRIHRRGNMNVLDVENL

SEQ ID NO: 15555 - protein, 420 aa, Homo Sapiens
MATSLGSNTYNRQNWEDADFPILCQTCLGENPYIRMTKEKYGKECKICARPFTVFRWCPGVRMRFKKTEVCQTCSKLKNVCQTCLLDLEYGLPIQVRDAGLSFKDDMPKSDVNKEYYTQNMEREISNSDGTRPVGMLGKATSTSDMLLKLARTTPYYKRNRPHICSFWVKGECKRGEECPYRHEKPTDPDDPLADQNIKDRYYGINDPVADKLLKRASTMPRLDPPEDKTITTLYVGGLGDTITETDLRNHFYQFGEIRTITVVQRQQCAFIQFATRQAAEVAAEKSFNKLIVNGRRLNVKWGRSQAARGKEKEKDGTTDSGIKLEPVPGLPGALPPPPAAEEEASANYFNLPPSGPPAVVNIALPPPPGIAPPPPPGFGPHMFHPMGPPPPFMRAPGPIHYPSQDPQRMGAHAGKHSSP

SEQ ID NO: 15556 - protein, 500 aa, Homo Sapiens
MDHTEGSPAEEPPAHAPSPGKFGERPPPKRLTREAMRNYLKERGDQTVLILHAKVAQKSYGNEKRFFCPPPCVYLMGSGWKKKKEQMERDGCSEQESQPCAFIGIGNSDQEMQQLNLEGKNYCTAKTLYISDSDKRKHFMLSVKMFYGNSDDIGVFLSKRIKVISKPSKKKQSLKNADLCIASGTKVALFNRLRSQTVSTRYLHVEGGNFHASSQQWGAFFIHLLDDDESEGEEFTVRDGYIHYGQTVKLVCSVTGMALPRLIIRKVDKQTALLDADDPVSQLHKCAFYLKDTERMYLCLSQERIIQFQATPCPKEPNKEMINDGASWTIISTDKAEYTFYEGMGPVLAPVTPVPVVESLQLNGGGDVAMLELTGQNFTPNLRVWFGDVEAETMYRCGESMLCVVPDISAFREGWRWVRQPVQVPVTLVRNDGIIYSTSLTFTYTPEPGPRPHCSAAGAILRANSSQVPPNESNTNSEGSYTNASTNSTSVTSSTATVVS

SEQ ID NO: 15557 - protein, 517 aa, Homo Sapiens
MDPAGAADPSVPPNPLTHLSLQDRSEMQLQSEADRRSLPGTWTRSSPEHTTILRGGVRRCLQQQCEQTVRILHAKVAQKSYGNEKRFFCPPPCVYLSGPGWRVKPGQDQAHQAGETGPTVCGYMGLDSASGSATETQKLNFEQQPDSREFGCAKTLYISDADKRKHFRLVLRLVLRGGRELGTFHSRLIKVISKPSQKKQSLKNTDLCISSGSKVSLFNRLRSQTVSTRYLSVEDGAFVASARQWAAFTLHLADGHSAQGDFPPREGYVRYGSLVQLVCTVTGITLPPMIIRKVAKQCALLDVDEPISQLHKCAFQFPGSPPGGGGTYLCLATEKVVQFQASPCPKEANRALLNDSSCWTIIGTESVEFSFSTSLACTLEPVTPVPLISTLELSGGGDVATLELHGENFHAGLKVWFGDVEAETMYRSPRSLVCVVPDVAAFCSDWRWLRAPITIPMSLVRADGLFYPSAFSFTYTPEYSVRPGHPGVPEPATDADALLESIHQEFTRTNFHLFIQT

SEQ ID NO: 15558 - protein, 1133 aa, Homo Sapiens
MPVQAPQWTDFLSCPICTQTFDETIRKPISLGCGHTVCKMCLNKLHRKACPFDQTTINTDIELLPVNSALLQLVGAQVPEQQPITLCSGVEDTKHYEEAKKCVEELALYLKPLSSARGVGLNSTTQSVLSRPMQRKLVTLVHCQLVEEEGRIRAMRAARSLGERTVTELILQHQNPQQLSSNLWAAVRARGCQFLGPAMQEEALKLVLLALEDGSALSRKVLVLFVVQRLEPRFPQASKTSIGHVVQLLYRASCFKVTKRDEDSSLMQLKEEFRTYEALRREHDSQIVQIAMEAGLRIAPDQWSSLLYGDQSHKSHMQSIIDKLQTPASFAQSVQELTIALQRTGDPANLNRLRPHLELLANIDPSPDAPPPTWEQLENGLVAVRTVVHGLVDYIQNHSKKGADQQQPPQHSKYKTYMCRDMKQRGGCPRGASCTFAHSQEELEKFRKMNKRLVPRRPLSASLGQLNEVGLPSAAILPDEGAVDLPSRKPPALPNGIVSTGNTVTQLIPRGTDPSYDSSLKPGKIDHLSSSAPGSPPDLLESVPKSISALPVNPHSIPPRGPADLPPMPVTKPLQMVPRGSQLYPAQQTDVYYQDPRGAAPPFEPAPYQQGMYYTPPPQCVSRFVRPPPSAPEPAPPYLDHYPPYLQERVVNSQYGTQPQQYPPIYPSHYDGRRVYPAPSYTREEIFRESPIPIEIPPAAVPSYVPESRERYQQIESYYPVAPHPTQIRPSYLREPPYSRLPPPPQPHPSLDELHRRRKEIMAQLEERKVISPPPFAPSPTLPPTFHPEEFLDEDLKVAGKYKGNDYSQYSPWSCDTIGSYIGTKDAKPKDVVAAGSVEMMNVESKGMRDQRLDLQRRAAETSDDDLIPFGDRPTVSRFGAISRTSKTIYQGAGPMQAMAPQGAPTKSINISDYSPYGTHGGWGASPYSPHQNIPSQGHFSERERISMSEVASHGKPLPSAEREQLRLELQQLNHQISQQTQLRGLEAVSNRLVLQREANTLAGQSQPPPPPPPKWPGMISSEQLSLELHQVEREIGKRTRELSMENQCSLDMKSKLNTSKQAENGQPEPQNKVPAEDLTLTFSDVPNGSALTQENISLLSNKTSSLNLSEDPEGGGDNNDSQRSGVTPSSAP

SEQ ID NO: 15559 - protein, 1191 aa, Homo Sapiens
MPVQAAQWTEFLSCPICYNEFDENVHKPISLGCSHTVCKTCLNKLHRKACPFDQTAINTDIDVLPVNFALLQLVGAQVPDHQSIKLSNLGENKHYEVAKKCVEDLALYLKPLSGGKGVASLNQSALSRPMQRKLVTLVNCQLVEEEGRVRAMRAARSLGERTVTELILQHQNPQQLSANLWAAVRARGCQFLGPAMQEEALKLVLLALEDGSALSRKVLVLFVVQRLEPRFPQASKTSIGHVVQLLYRASCFKVTKRDEDSSLMQLKEEFRSYEALRREHDAQIVHIAMEAGLRISPEQWSSLLYGDLAHKSHMQSIIDKLQSPESFAKSVQELTIVLQRTGDPANLNRLRPHLELLANIDPNPDAVSPTWEQLENAMVAVKTVVHGLVDFIQNYSRKGHETPQPQPNSKYKTSMCRDLRQQGGCPRGTNCTFAHSQEELEKYRLRNKKINATVRTFPLLNKVGVNNTVTTTAGNVISVIGSTETTGKIVPSTNGISNAENSVSQLISRSTDSTLRALETVKKVGKVGANGQNAAGPSADSVTENKIGSPPKTPVSNVAATSAGPSNVGTELNSVPQKSSPFLTRVPVYPPHSENIQYFQDPRTQIPFEVPQYPQTGYYPPPPTVPAGVAPCVPRFVRSNNVPESSLPPASMPYADHYSTFSPRDRMNSSPYQPPPPQPYGPVPPVPSGMYAPVYDSRRIWRPPMYQRDDIIRSNSLPPMDVMHSSVYQTSLRERYNSLDGYYSVACQPPSEPRTTVPLPREPCGHLKTSCEEQIRRKPDQWAQYHTQKAPLVSSTLPVATQSPTPPSPLFSVDFRADFSESVSGTKFEEDHLSHYSPWSCGTIGSCINAIDSEPKDVIANSNAVLMDLDSGDVKRRVHLFETQRRTKEEDPIIPFSDGPIISKWGAISRSSRTGYHTTDPVQATASQGSATKPISVSDYVPYVNAVDSRWSSYGNEATSSAHYVERDRFIVTDLSGHRKHSSTGDLLSLELQQAKSNSLLLQREANALAMQQKWNSLDEGRHLTLNLLSKEIELRNGELQSDYTEDATDTKPDRDIELELSALDTDEPDGQSEPIEEILDIQLGISSQNDQLLNGMAVENGHPVQQHQKEPPKQKKQSLGEDHVILEEQKTILPVTSCFSQPLPVSISNASCLPITTSVSAGNLILKTHVMSEDKNDFLKPVANGKMVNS

SEQ ID NO: 15560 - protein, 485 aa, Homo Sapiens; identical to SEQ ID NO: 11271

SEQ ID NO: 15561 - protein, 523 aa, Homo Sapiens
MPSVMEKPSAGSGILSRSRAKTVPNGGQPHSEDDSSEEEHSHDSMIRVGTNYQAVIPECKPESPARYSNKELKGMLVWSPNHCVSDAKLDKYIAMAKEKHGYNIEQALGMLLWHKHDVEKSLADLANFTPFPDEWTVEDKVLFEQAFGFHGKCFQRIQQMLPDKLIPSLVKYYYSWKKTRSRTSVMDRQARRLGGRKDKEDSDELEEGRGGVSEGEPDPADPKREPLPSRPLNARPGPGKKEVQVSQYRHHPLRTRRRPPKGMYLSPEGLTAVSGSPDLANLTLRGLDSQLISLKRQVQSMKQTNSSLRQALEGGIDPLRPPEANTKFNSRWTTDEQLLAVQAIRRYGKDFGAIAEVIGNKTLTQVKTFFVSYRRRFNLEEVLQEWEAEQDGAPGAPVPMEEARRGAPLPAPALEEDDEVQITSVSTSVPRSVPPAPPPPPPPTSLSQPPPLLRPPLPTAPTLLRQPPPLQQGRFLQPRLAPNQPPPPLIRPALAAPRHSARPGPQPPPTLIGTPLEPPAPSL

SEQ ID NO: 15562 - protein, 495 aa, Homo Sapiens
MRVGAEYQARIPEFDPGATKYTDKDNGGMLVWSPYHSIPDAKLDEYIAIAKEKHGYNVEQALGMLFWHKHNIEKSLADLPNFTPFPDEWTVEDKVLFEQAFSFHGKSFHRIQQMLPDKTIASLVKYYYSWKKTRSRTSLMDRQARKLANRHNQGDSDDDVEETHPMDGNDSDYDPKKEAKKEGNTEQPVQTSKIGLGRREYQSLQHRHHSQRSKCRPPKGMYLTQEDVVAVSCSPNAANTILRQLDMELISLKRQVQNAKQVNSALKQKMEGGIEEFKPPESNQKINARWTTEEQLLAVQGVRKYGKDFQAIADVIGNKTVGQVKNFFVNYRRRFNLEEVLQEWEAEQGTQASNGDASTLGEETKSASNVPSGKSTDEEEEAQTPQAPRTLGPSPPAPSSTPTPTAPIATLNQPPPLLRPTLPAAPALHRQPPPLQQQARFIQPRPTLNQPPPPLIRPANSMPPRLNPRPVLSTVGGQQPPSLIGIQTDSQSSLH

SEQ ID NO: 15563 - protein, 619 aa, Homo Sapiens
MASGAYNPYIEIIEQPRQRGMRFRYKCEGRSAGSIPGEHSTDNNRTYPSIQIMNYYGKGKVRITLVTKNDPYKPHPHDLVGKDCRDGYYEAEFGQERRPLFFQNLGIRCVKKKEVKEAIITRIKAGINPFNVPEKQLNDIEDCDLNVVRLCFQVFLPDEHGNLTTALPPVVSNPIYDNRAPNTAELRICRVNKNCGSVRGGDEIFLLCDKVQKDDIEVRFVLNDWEAKGIFSQADVHRQVAIVFKTPPYCKAITEPVTVKMQLRRPSDQEVSESMDFRYLPDEKDTYGNKAKKQKTTLLFQKLCQDHVETGFRHVDQDGLELLTSGDPPTLASQSAGITVNFPERPRPGLLGSIGEGRYFKKEPNLFSHDAVVREMPTGVSSQAESYYPSPGPISSGLSHHASMAPLPSSSWSSVAHPTPRSGNTNPLSSFSTRTLPSNSQGIPPFLRIPVGNDLNASNACIYNNADDIVGMEASSMPSADLYGISDPNMLSNCSVNMMTTSSDSMGETDNPRLLSMNLENPSCNSVLDPRDLRQLHQMSSSSMSAGANSNTTVFVSQSDAFEGSDFSCADNSMINESGPSNSTNPNSHGFVQDSQYSGIGSMQNEQLSDSFPYEFFQV

SEQ ID NO: 15564 - protein, 551 aa, Homo Sapiens
MDELFPLIFPAEPAQASGPYVEIIEQPKQRGMRFRYKCEGRSAGSIPGERSTDTTKTHPTIKINGYTGPGTVRISLVTKDPPHRPHPHELVGKDCRDGFYEAELCPDRCIHSFQNLGIQCVKKRDLEQAISQRIQTNNNPFQVPIEEQRGDYDLNAVRLCFQVTVRDPSGRPLRLPPVLSHPIFDNRAPNTAELKICRVNRNSGSCLGGDEIFLLCDKVQKEDIEVYFTGPGWEARGSFSQADVHRQVAIVFRTPPYADPSLQAPVRVSMQLRRPSDRELSEPMEFQYLPDTDDRHRIEEKRKRTYETFKSIMKKSPFSGPTDPRPPPRRIAVPSRSSASVPKPAPQPYPFTSSLSTINYDEFPTMVFPSGQISQASALAPAPPQVLPQAPAPAPAPAMVSALAQAPAPVPVLAPGPPQAVAPPAPKPTQAGEGTLSEALLQLQFDDEDLGALLGNSTDPAVFTDLASVDNSEFQQLLNQGIPVAPHTTEPMLMEYPEAITRLVTGAQRPPDPAPAPLGAPGLPNGLLSGDEDFSSIADMDFSALLSQISS

SEQ ID NO: 15565 - protein, 579 aa, Homo Sapiens
MLRSGPASGPSVPTGRAMPSRRVARPPAAPELGALGSPDLSSLSLAVSRSTDELEIIDEYIKENGFGLDGGQPGPGEGLPRLVSRGAASLSTVTLGPVAPPATPPPWGCPLGRLVSPAPGPGPQPHLVITEQPKQRGMRFRYECEGRSAGSILGESSTEASKTLPAIELRDCGGLREVEVTACLVWKDWPHRVHPHSLVGKDCTDGICRVRLRPHVSPRHSFNNLGIQCVRKKEIEAAIERKIQLGIDPYNAGSLKNHQEVDMNVVRICFQASYRDQQGQMRRMDPVLSEPVYDKKSTNTSELRICRINKESGPCTGGEELYLLCDKVQKEDISVVFSRASWEGRADFSQADVHRQIAIVFKTPPYEDLEIVEPVTVNVFLQRLTDGVCSEPLPFTYLPRDHDSYGVDKKRKRGMPDVLGELNSSDPHGIESKRRKKKPAILDHFLPNHGSGPFLPPSALLPDPDFFSGTVSLPGLEPPGGPDLLDDGFAYDPTAPTLFTMLDLLPPAPPHASAVVCSGGAGAVVGETPGPEPLTLDSYQAPGPGDGGTASLVGSNMFPNHYREAAFGGGLLSPGPEAT

SEQ ID NO: 15566 - protein, 1566 aa, Homo Sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFAAREFKARVDSFFYILGYNPETRRLNSTQGEIRVGPSHQAKLPDLQPFPSPDGDTVTQHEELVWMPGVNDCDLLMYLRAARSMAAFAGMCDGGSTEDGCVAASRDDTTLNALNTLHESGYDAGKALQRLVKKPVPKLIEKCWTEDEVKRFVKGLRQYGKNFFRIRKELLPNKETGELITFYYYWKKTPEAASSRAHRRHRRQAVFRRIKTRTASTPVNTPSRPPSSEFLDLSSASEDDFDSEDSEQELKGYACRHCFTTTSKDWHHGGRENILLCTDCRIHFKKYGELPPIEKPVDPPPFMFKPVKEEDDGLSGKHSMRTRRSRGSMSTLRSGRKKQPASPDGRTSPINEDIRSSGRNSPSAASTSSNDSKAETVKKSAKKVKEEASSPLKSNKRQREKVASDTEEADRTSSKKTKTQEISRPNSPSEGEGESSDSRSVNDEGSSDPKDIDQDNRSTSPSIPSPQDNESDSDSSAQQQMLQAQPPALQAPTGVTPAPSSAPPGTPQLPTPGPTPSATAVPPQGSPTASQAPNQPQAPTAPVPHTHIQQAPALHPQRPPSPHPPPHPSPHPPLQPLTGSAGQPSAPSHAQPPLHGQGPPGPHSLQAGPLLQHPGPPQPFGLPPQASQGQAPLGTSPAAAYPHTSLQLPASQSALQSQQPPREQPLPPAPLAMPHIKPPPTTPIPQLPAPQAHKHPPHLSGPSPFSMNANLPPPPALKPLSSLSTHHPPSAHPPPLQLMPQSQPLPSSPAQPPGLTQSQNLPPPPASHPPTGLHQVAPQPPFAQHPFVPGGPPPITPPTCPSTSTPPAGPGTSAQPPCSGAAASGGSIAGGSSCPLPTVQIKEEALDDAEEPESPPPPPRSPSPEPTVVDTPSHASQSARFYKHLDRGYNSCARTDLYFMPLAGSKLAKKREEAIEKAKREAEQKAREEREREKEKEKEREREREREREAERAAKASSSAHEGRLSDPQLSGPGHMRPSFEPPPTTIAAVPPYIGPDTPALRTLSEYARPHVMSPTNRNHPFYMPLNPTDPLLAYHMPGLYNVDPTIRERELREREIREREIRERELRERMKPGFEVKPPELDPLHPAANPMEHFARHSALTIPPTAGPHPFASFHPGLNPLERERLALAGPQLRPEMSYPDRLAAERIHAERMASLTSDPLARLQMFNVTPHHHQHSHIHSHLHLHQQDPLHQGSAGPVHPLVDPLTAGPHLARFPYPPGTLPNPLLGQPPHEHEMLRHPVFGTPYPRDLPGAIPPPMSAAHQLQAMHAQSAELQRLAMEQQWLHGHPHMHGGHLPSQEDYYSRLKKEGDKQL

SEQ ID NO: 15567 - protein, 1097 aa, Homo Sapiens
MATQVMGQSSGGGGLFTSSGNIGMALPNDMYDLHDLSKAELAAPQLIMLANVALTGEVNGSCCDYLVGEERQMAELMPVGDNNFSDSEEGEGLEESADIKGEPHGLENMELRSLELSVVEPQPVFEASGAPDIYSSNKDLPPETPGAEDKGKSSKTKPFRCKPCQYEAESEEQFVHHIRVHSAKKFFVEESAEKQAKARESGSSTAEEGDFSKGPIRCDRCGYNTNRYDHYTAHLKHHTRAGDNERVYKCIICTYTTVSEYHWRKHLRNHFPRKVYTCGKCNYFSDRKNNYVQHVRTHTGERPYKCELCPYSSSQKTHLTRHMRTHSGEKPFKCDQCSYVASNQHEVTRHARQVHNGPKPLNCPHCDYKTADRSNFKKHVELHVNPRQFNCPVCDYAASKKCNLQYHFKSKHPTCPNKTMDVSKVKLKKTKKREADLPDNITNEKTEIEQTKIKGDVAGKKNEKSVKAEKRDVSKEKKPSNNVSVIQVTTRTRKSVTEVKEMDVHTGSNSEKFSKTKKSKRKLEVDSHSLHGPVNDEESSTKKKKKVESKSKNNSQEVPKGDSKVEENKKQNTCMKKSTKKKTLKNKSSKKSSKPPQKEPVEKGSAQMDPPQMGPAPTEAVQKGPVQVEPPPPMEHAQMEGAQIRPAPDEPVQMEVVQEGPAQKELLPPVEPAQMVGAQIVLAHMELPPPMETAQTEVAQMGPAPMEPAQMEVAQVESAPMQVVQKEPVQMELSPPMEVVQKEPVQIELSPPMEVVQKEPVKIELSPPIEVVQKEPVQMELSPPMGVVQKEPAQREPPPPREPPLHMEPISKKPPLRKDKKEKSNMQSERARKEQVLIEVGLVPVKDSWLLKESVSTEDLSPPSPPLPKENLREEASGDQKLLNTGEGNKEAPLQKVGAEEADESLPGLAANINESTHISSSGQNLNTPEGETLNGKHQTDSIVCEMKMDTDQNTRENLTGINSTVEEPVSPMLPPSAVEEREAVSKTALASPPATMAANESQEIDEDEGIHSHEGSDLSDNMSEGSDDSGLHGARPVPQESSRKNAKEALAVKAAKGDFVCIFCDRSFRKGKDYSKHLNRHLVNVYYLEEAAQGQE

SEQ ID NO: 15568 - protein, 979 aa, Homo Sapiens
MATQAYTELQAAPPPSQPPQAPPQAQPQPPPPPPPAAPQPPQPPTAAATPQPQYVTELQSPQPQAQPPGGQKQYVTELPAVPAPSQPTGAPTPSPAPQQYIVVTVSEGAMRASETVSEASPGSTASQTGVPTQVVQQVQGTQQRLLVQTSVQAKPGHVSPLQLTNIQVPQQALPTQRLVVQSAAPGSKGGQVSLTVHGTQQVHSPPEQSPVQANSSSSKTAGAPTGTVPQQLQVHGVQQSVPVTQERSVVQATPQAPKPGPVQPLTVQGLQPVHVAQEVQQLQQVPVPHVYSSQVQYVEGGDASYTASAIRSSTYSYPETPLYTQTASTSYYEAAGTATQVSTPATSQAVASSGSMPMYVSGSQVVASSTSTGAGASNSSGGGGSGGGGGGGGGGGGGGSGSTGGGGSGAGTYVIQGGYMLGSASQSYSHTTRASPATVQWLLDNYETAEGVSLPRSTLYCHYLLHCQEQKLEPVNAASFGKLIRSVFMGLRTRRLGTRGNSKYHYYGLRIKASSPLLRLMEDQQHMAMRGQPFSQKQRLKPIQKMEGMTNGVAVGQQPSTGLSDISAQVQQYQQFLDASRSLPDFTELDLQGKVLPEGVGPGDIKAFQVLYREHCEAIVDVMVNLQFTLVETLWKTFWRYNLSQPSEAPPLAVHDEAEKRLPKAILVLLSKFEPVLQWTKHCDNVLYQGLVEILIPDVLRPIPSALTQAIRNFAKSLESWLTHAMVNIPEEMLRVKVAAAGAFAQTLRRYTSLNHLAQAARAVLQNTAQINQMLSDLNRVDFANVQEQASWVCRCEDRVVQRLEQDFKVTLQQQNSLEQWAAWLDGVVSQVLKPYQGSAGFPKAAKLFLLKWSFYSSMVIRDLTLRSAASFGSFHLIRLLYDEYMYYLIEHRVAQAKGETPIAVMGEFANLATSLNPLDPDKDEEEEEEEESEDELPQDISLAAGGESPALGPETLEPPAKLARTDARGLFVQALPSS

SEQ ID NO: 15569 - protein, 723 aa, Homo Sapiens
MQNSEGGADSPASVALRPSAAAPPVPASPQRVLVQAASSNPKGAQMQPISLPRVQQVPQQVQPVQHVYPAQVQYVEGGDAVYTNGAIRTAYTYNPEPQMYAPSSTASYFEAPGGAQVTVAASSPPAVPSHSMVGITMDVGGSPIVSSAGAYLIHGGMDSTRHSLAHTSRSSPATLEMAIENLQKSEGITSHKSGLLNSHLQWLLDNYETAEGVSLPRSSLYNHYLRHCQEHKLDPVNAASFGKLIRSVFMGLRTRRLGTRGNSKYHYYGIRLKPDSPLNRLQEDTQYMAMRQQPMHQKPRYRPAQKTDSLGDSGSHSGLHSTPEQTMAVQSQHHQQYIDVSHVFPEFPAPDLGSFLLQDGVTLHDVKALQLVYRRHCEATVDVVMNLQFHYIEKLWLSFWNSKASSSDGPTSLPASDEDPEGAVLPKDKLISLCQCDPILRWMRSCDHILYQALVEILIPDVLRPVPSTLTQAIRNFAKSLEGWLTNAMSDFPQQVIQTKVGVVSAFAQTLRRYTSLNHLAQAARAVLQNTSQINQMLSDLNRVDFANVQEQASWVCQCEESVVQRLEQDFKLTLQQQSSLDQWASWLDSVVTQVLKQHAGSPSFPKAARQFLLKWSFYSSMVIRDLTLRSAASFGSFHLIRLLYDEYMFYLVEHRVAEATGETPIAVMGEFNDLASLSLTLLDKDDMGDEQRGSEAGPDARSLGEPLVKRERSDPNHSLQGI

SEQ ID NO: 15570 - protein, 749 aa, Homo Sapiens
MQTSETGSDTGSTVTLQTSVASQAAVPTQVVQQVPVQQQVQQVQTVQQVQHVYPAQVQYVEGSDTVYTNGAIRTTTYPYTETQMYSQNTGGNYFDTQGSSAQVTTVVSSHSMVGTGGIQMGVTGGQLISSSGGTYLIGNSMENSGHSVTHTTRASPATIEMAIETLQKSDGLSTHRSSLLNSHLQWLLDNYETAEGVSLPRSTLYNHYLRHCQEHKLDPVNAASFGKLIRSIFMGLRTRRLGTRGNSKYHYYGIRVKPDSPLNRLQEDMQYMAMRQQPMQQKQRYKPMQKVDGVADGFTGSGQQTGTSVEQTVIAQSQHHQQFLDASRALPEFGEVEISSLPDGTTFEDIKSLQSLYREHCEAILDVVVNLQFSLIEKLWQTFWRYSPSTPTDGTTITESSNLSEIESRLPKAKLITLCKHESILKWMCNCDHGMYQALVEILIPDVLRPIPSALTQAIRNFAKSLEGWLSNAMNNIPQRMIQTKVAAVSAFAQTLRRYTSLNHLAQAARAVLQNTSQINQMLSDLNRVDFANVQEQASWVCQCDDNMVQRLETDFKMTLQQQSTLEQWAAWLDNVMMQALKPYEGRPSFPKAARQFLLKWSFYSSMVIRDLTLRSAASFGSFHLIRLLYDEYMFYLVEHRVAQATGETPIAVMGEFGDLNAVSPGNLDKDEGSEVESEMDEELDDSSEPQAKREKTELSQAFPVGCMQPVLETGVQPSLLNPIHSEHIVTSTQTIRQCSATGNTYTAV

SEQ ID NO: 15571 - protein, 735 aa, Homo Sapiens
MHCGLLEEPDMDSTESWIERCLNESENKRYSSHTSLGNVSNDENEEKENNRASKPHSTPATLQWLEENYEIAEGVCIPRSALYMHYLDFCEKNDTQPVNAASFGKIIRQQFPQLTTRRLGTRGQSKYHYYGIAVKESSQYYDVMYSKKGAAWVSETGKKEVSKQTVAYSPRSKLGTLLPEFPNVKDLNLPASLPEEKVSTFIMMYRTHCQRILDTVIRANFDEVQSFLLHFWQGMPPHMLPVLGSSTVVNIVGVCDSILYKAISGVLMPTVLQALPDSLTQVIRKFAKQLDEWLKVALHDLPENLRNIKFELSRRFSQILRRQTSLNHLCQASRTVIHSADITFQMLEDWRNVDLNSITKQTLYTMEDSRDEHRKLITQLYQEFDHLLEEQSPIESYIEWLDTMVDRCVVKVAAKRQGSLKKVAQQFLLMWSCFGTRVIRDMTLHSAPSFGSFHLIHLMFDDYVLYLLESLHCQERANELMRAMKGEGSTAEVREEIILTEAAAPTPSPVPSFSPAKSATSVEVPPPSSPVSNPSPEYTGLSTTGAMQSYTWSLTYTVTTAAGSPAENSQQLPCMRNTHVPSSSVTHRIPVYPHREEHGYTGSYNYGSYGNQHPHPMQSQYPALPHDTAISGPLHYAPYHRSSAQYPFNSPTSRMEPCLMSSTPRLHPTPVTPRWPEVPSANTCYTSPSVHSARYGNSSDMYTPLTTRRNSEYEHMQHFPGFAYINGEASTGWAK

SEQ ID NO: 15572 - protein, 616 aa, Homo Sapiens
MAEDEPDAKSPKTGGRAPPGGAEAGEPTTLLQRLRGTISKAVQNKVEGILQDVQKFSDNDKLYLYLQLPSGPTTGDKSSEPSTLSNEEYMYAYRWIRNHLEEHTDTCLPKQSVYDAYRKYCESLACCRPLSTANFGKIIREIFPDIKARRLGGRGQSKYCYSGIRRKTLVSMPPLPGLDLKGSESPEMGPEVTPAPRDELVEAACALTCDWAERILKRSFSSIVEVARFLLQQHLISARSAHAHVLKAMGLAEEDEHAPRERSSKPKNGLENPEGGAHKKPERLAQPPKDLEARTGAGPLARGERKKSVVESSAPGANNLQVNALVARLPLLLPRAPRSLIPPIPVSPPILAPRLSSGALKVATLPLSSRAGAPPAAVPIINMILPTVPALPGPGPGPGRAPPGGLTQPRGTENREVGIGGDQGPHDKGVKRTAEVPVSEASGQAPPAKAAKQDIEDTASDAKRKRGRPRKKSGGSGERNSTPLKSAAAMESAQSSRLPWETWGSGGEGNSAGGAERPGPMGEAEKGAVLAQGQGDGTVSKGGRGPGSQHTKEAEDKIPLVPSKVSVIKGSRSQKEAFPLAKGEVDTAPQGNKDLKEHVLQSSLSQEHKDPKATPP

SEQ ID NO: 15573 - protein, 928 aa, Homo Sapiens
MAKVPELEDTFLQAQPAPQLSPGIQEDCCVQLLGKGLLVYPEETVYLAAEGQPGGEQGGGEKGEDPELPGAVKSEMHLNNGNFSSEEEDADNHDSKTKAADQYLSQKKTITQIVKDKKKQTQLTLQWLEENYIVCEGVCLPRCILYAHYLDFCRKEKLEPACAATFGKTIRQKFPLLTTRRLGTRGHSKYHYYGIGIKESSAYYHSVYSGKGLTRFSGSKLKNEGGFTRKYSLSSKTGTLLPEFPSAQHLVYQGCISKDKVDTLIMMYKTHCQCILDNAINGNFEEIQHFLLHFWQGMPDHLLPLLENPVIIDIFCVCDSILYKVLTDVLIPATMQEMPESLLADIRNFAKNWEQWVVSSLENLPEALTDKKIPIVRRFVSSLKRQTSFLHLAQIARPALFDQHVVNSMVSDIERVDLNSIGSQALLTISGSTDTESGIYTEHDSITVFQELKDLLKKNATVEAFIEWLDTVVEQRVIKTSKQNGRSLKKRAQDFLLKWSFFGARVMHNLTLNNASSFGSFHLIRMLLDEYILLAMETQFNNDKEQELQNLLDKYMKNSDASKAAFTASPSSCFLANRNKGSMVSSDAVKNESHVETTYLPLPSSQPGGLGPALHQFPAGNTDNMPLTGQMELSQIAGHLMTPPISPAMASRGSVINQGPMAGRPPSVGPVLSAPSHCSTYPEPIYPTLPQANHDFYSTSSNYQTVFRAQPHSTSGLYPHHTEHGRCMAWTEQQLSRDFFSGSCAGSPYNSRPPSSYGPSLQAQDSHNMQFLNTGSFNFLSNTGAASCQGATLPPNSPNGYYGSNINYPESHRLGSMVNQHVSVISSIRSLPPYSDIHDPLNILDDSGRKQTSSFYTDTSSPVACRTPVLASSLQTPIPSSSSQCMYGTSNQYPAQETLDSHGTSSREMVSSLPPINTVFMGTAAGGT

SEQ ID NO: 15574 - protein, 1363 aa, Homo Sapiens
MSSSRAQQMHAFSWIRNTLEEHPETSLPKQEVYDEYKSYCDNLGYHPLSAADFGKIMKNVFPNMKARRLGTRGKSKYCYSGLRKKAFVHMPTLPNLDFHKTGDGLEGAEPSGQLQNIDEEVISSACRLVCEWAQKVLSQPFDTVLELARFLVKSHYIGTKSMAALTVMAAAPAGMKGITQPSAFIPTAESNSFQPQVKTLPSPIDAKQQLQRKIQKKQQEQKLQSPLPGESAAKKSESATSNGVTNLPNGNPSILSPQPIGIVVAAVPSPIPVQRTRQLVTSPSPMSSSDGKVLPLNVQVVTQHMQSVKQAPKTPQNVPASPGGDRSARHRYPQILPKPANTSALTIRSPTTVLFTSSPIKTAVVPASHMSSLNVVKMTTISLTPSNSNTPLKHSASVSSATGTTEESRSVPQIKNGSVVSLQSPGSRSSSAGGTSAVEVKVEPETSSDEHPVQCQENSDEAKAPQTPSALLGQKSNTDGALQKPSNEGVIEIKATKVCDQRTKCKSRCNEMLPGTSTGNNQSTITLSVASQNLTFTSSSSPPNGDSINKDPKLCTKSPRKRLSSTLQETQVPPVKKPIVEQLSAATIEGQKQGSVKKDQKVPHSGKTEGSTAGAQIPSKVSVNVSSHIGANQPLNSSALVISDSALEQQTTPSSSPDIKVKLEGSVFLLDSDSKSVGSFNPNGWQQITKDSEFISASCEQQQDISVMTIPEHSDINDLEKSVWELEGMPQDTYSQQLHSQIQESSLNQIQAHSSDQLPLQSELKEFEPSVSQTNESYFPFDDELTQDSIVEELVLMEQQMSMNNSHSYGNCLGMTLQSQSVTPGAPMSSHTSSTHFYHPIHSNGTPIHTPTPTPTPTPTPTPTPTPTSEMIAGSQSLSRESPCSRLAQTTPVDSALGSSRHTPIGTPHSNCSSSVPPSPVECRNPFAFTPISSSMAYHDASIVSSSPVKPMQRPMATHPDKTKLEWMNNGYSGVGNSSVSGHGILPSYQELVEDRFRKPHAFAVPGQSYQSQSRHHDTHFGRLTPVSPVQHQGATVNNTNKQEGFAVPAPLDNKGTNSSASSNFRCRSVSPAVHRQRNLSGSTLYPVSNIPRSNVTPFGSPVTPEVHVFTNVHTDACANNIAQRSQSVPLTVMMQTAFPNALQKQANSKKITNVLLSKLDSDNDDAVRGLGMNNLPSNYTARMNLTQILEPSTVFPSANPQNMIDSSTSVYEFQTPSYLTKSNSTGQINFSPGDNQAQSEIGEQQLDFNSTVKDLLSGDSLQTNQQLVGQGASDLTNTASDFSSDIRLSSELSGSINDLNTLDPNLLFDPGRQQGQDDEATLEELKNDPLFQQICSESMNSMTSSGFEWIESKDHPTVEMLG

SEQ ID NO: 15575 - protein, 586 aa, Homo Sapiens
MAEGVPASPSSGEGSRGPHSGVIQWLVDNFCICEECSVPRCLMYEIYVETCGQNTENQVNPATFGKLVRLVFPDLGTRRLGTRGSARYHYDGICIKKSSFFYAQYCYLIGEKRYHSGDAIAFEKSTNYNSIIQQEATCEDHSPMKTDPVGSPLSEFRRCPFLEQEQAKKYSCNMMAFLADEYCNYCRDILRNVEDLLTSFWKSLQQDTVMLMSLPDVCQLFKCYDVQLYKGIEDVLLHDFLEDVSIQYLKSVQLFSKKFKLWLLNALEGVPALLQISKLKEVTLFVKRLRRKTYLSNMAKTMRMVLKSKRRVSVLKSDLQAIINQGTLATSKKALASDRSGADELENNPEMKCLRNLISLLGTSTDLRVFLSCLSSHLQAFVFQTSRSKEEFTKLAASFQLRWNLLLTAVSKAMTLCHRDSFGSWHLFHLLLLEYMIHILQSCLEEEEEEEDMGTVKEMLPDDPTLGQPDQALFHSLNSSLSQACASPSMEPLGVMPTHMGQGRYPVGVSNMVLRILGFLVDTAMGNKLIQVLLEDETTESAVKLSLPMGQEALITLKDGQQFVIQISDVPQSSEDIYFRENNANV

SEQ ID NO: 15576 - protein, 260 aa, Homo Sapiens
MELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLVPADPE

SEQ ID NO: 15577 - protein, 272 aa, Homo Sapiens
MEAQGVAEGAGPGAASGVPHPAALAPAAAPTLAPASVAAAASQFTLLVMQPCAGQDEAAAPGGSVGAGKPVRYLCEGAGDGEEEAGEDEADLLDTSDPPGGGESAASLEDLEDEETHSGGEGSSGGARRRGSGGGSMSKTCTYEGCSETTSQVAKQRKPWMCKKHRNKMYKDKYKKKKSDQALNCGGTASTGSAGNVKLEESADNILSIVKQRTGSFGDRPARPTLLEQVLNQKRLSLLRSPEVVQFLQKQQQLLNQQVLEQRQQQFPGTSM

SEQ ID NO: 15578 - protein, 184 aa, Homo Sapiens
MARSLVHDTVFYCLSVYQVKISPTPQLGAASSAEGHVGQGAPGLMGNMNPEGGVNHENGMNRDGGMIPEGGGGNQEPRQQPQPPPEEPAQAAMEGPQPENMQPRTRRTKFTLLQVEELESVFRHTQYPDVPTRRELAENLGVTEDKVRVWFKNKRARCRRHQRELMLANELRADPDDCVYIVVD

SEQ ID NO: 15579 - protein, 288 aa, Homo Sapiens
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGDLEGTSGSDGNVEDSDQSEKEPGQQYSRPQGAVGGLEPGNAQQPNVHAFTPLQLQELERIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 15580 - protein, 288 aa, Homo Sapiens
MEPPDQCSQYMTSLLSPAVDDEKELQDMNAMVLSLTEEVKEEEEDAQPEPEQGTAAGEKLKSAGAQGGEEKDGGGEEKDGGGAGVPGHLWEGNLEGTSGSDGNVEDSDQSEKEPGQQYSRPQGAVGGLEPGNAQQPNVHAFTPLQLQELECIFQREQFPSEFLRRRLARSMNVTELAVQIWFENRRAKWRRHQRALMARNMLPFMAVGQPVMVTAAEAITAPLFISGMRDDYFWDHSHSSSLCFPMPPFPPPSLPLPLMLLPPMPPAGQAEFGPFPFVIVPSFTFPNV

SEQ ID NO: 15581 - protein, 131 aa, Homo Sapiens; identical to SEQ ID NO: 7198

SEQ ID NO: 15582 - protein, 1914 aa, Homo Sapiens
MADGKGDAAAVAGAGAEAPAVAGAGDGVETESMVRGHRPVSPAPGASGLRPCLWQLETELREQEVSEVSSLNYCRSFCQTLLQYASNKNASEHIVYLLEVYRLAIQSFASARPYLTTECEDVLLVLGRLVLSCFELLLSVSESELPCEVWLPFLQSLQESHDALLEFGNNNLQILVHVTKEGVWKNPVLLKILSQQPVETEEVNKLIAQEGPSFLQMRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTEAQDAGLGVSILLCVRALQLRSSEDEEMKASVCKTIACLLPEDLEVRRACQLTEFLIEPSLDGFNMLEELYLQPDQKFDEENAPVPNSLRCELLLALKAHWPFDPEFWDWKTLKRHCHQLLGQEASDSDDDLSGYEMSINDTDVLESFLSDYDEGKEDKQYRRRDLTDQHKEKRDKKPIGSSERYQRWLQYKFFCLLCKRECIEARILHHSKMHMEDGIYTCPVCIKKFKRKEMFVPHVMEHVKMPPSRRDRSKKKLLLKGSQKGICPKSPSAIPEQNHSLNDQAKGESHEYVTFSKLEDCHLQDRDLYPCPGTDCSRVFKQFKYLSVHLKAEHQNNDENAKHYLDMKNRREKCTYCRRHFMSAFHLREHEQVHCGPQPYMCVSIDCYARFGSVNELLNHKQKHDDLRYKCELNGCNIVFSDLGQLYHHEAQHFRDASYTCNFLGCKKFYYSKIEYQNHLSMHNVENSNGDIKKSVKLEESATGEKQDCINQPHLLNQTDKSHLPEDLFCAESANSQIDTETAENLKENSDSNSSDQLSHSSSASMNEELIDTLDHSETMQDVLLSNEKVFGPSSLKEKCSSMAVCFDGTKFTCGFDGCGSTYKNARGMQKHLRKVHPYHFKPKKIKTKDLFPSLGNEHNQTTEKLDAEPKPCSDTNSDSPDEGLDHNIHIKCKREHQGYSSESSICASKRPCTEDTMLELLLRLKHLSLKNSITHGSFSGSLQGYPSSGAKSLQSVSSISDLNFQNQDENMPSQYLAQLAAKPFFCELQGCKYEFVTREALLMHYLKKHNYSKEKVLQLTMFQHRYSPFQCHICQRSFTRKTHLRIHYKNKHQIGSDRATHKLLDNEKCDHEGPCSVDRLKGDCSAELGGDPSSNSEKPHCHPKKDECSSETDLESSCEETESKTSDISSPIGSHREEQEGREGRGSRRTVAKGNLCYILNKYHKPFHCIHKTCNSSFTNLKGLIRHYRTVHQYNKEQLCLEKDKARTKRELVKCKKIFACKYKECNKRFLCSKALAKHCSDSHNLDHIEEPKVLSEAGSAARFSCNQPQCPAVFYTFNKLKHHLMEQHNIEGEIHSDYEIHCDLNGCGQIFTHRSNYSQHVYYRHKDYYDDLFRSQKVANERLLRSEKVCQTADTQGHEHQTTRRSFNAKSKKCGLIKEKKAPISFKTRAEALHMCVEHSEHTQYPCMVQGCLSVVKLESSIVRHYKRTHQMSSAYLEQQMENLVVCVKYGTKIKEEPPSEADPCIKKEENRSCESERTEHSHSPGDSSAPIQNTDCCHSSERDGGQKGCIESSSVFDADTLLYRGTLKCNHSSKTTSLEQCNIVQPPPPCKIENSIPNPNGTESGTYFTSFQLPLPRIKESETRQHSSGQENTVKNPTHVPKENFRKHSQPRSFDLKTYKPMGFESSFLKFIQESEEKEDDFDDWEPSEHLTLSNSSQSSNDLTGNVVANNMVNDSEPEVDIPHSSSDSTIHENLTAIPPLIVAETTTVPSLENLRVVLDKALTDCGELALKQLHYLRPVVVLERSKFSTPILDLFPTKKTDELCVGSS

SEQ ID NO: 15583 - protein, 523 aa, Homo Sapiens
MESAPAAPDPAASEPGSSGADAAAGSRETPLNQESARKSEPPAPVRRQSYSSTSRGISVTKKTHTSQIEIIPCKICGDKSSGIHYGVITCEGCKGFFRRSQQSNATYSCPRQKNCLIDRTSRNRCQHCRLQKCLAVGMSRDAVKFGRMSKKQRDSLYAEVQKHRMQQQQRDHQQQPGEAEPLTPTYNISANGLTELHDDLSNYIDGHTPEGSKADSAVSSFYLDIQPSPDQSGLDINGIKPEPICDYTPASGFFPYCSFTNGETSPTVSMAELEHLAQNISKSHLETCQYLREELQQITWQTFLQEEIENYQNKQREVMWQLCAIKITEAIQYVVEFAKRIDGFMELCQNDQIVLLKAGSLEVVFIRMCRAFDSQNNTVYFDGKYASPDVFKSLGCEDFISFVFEFGKSLCSMHLTEDEIALFSAFVLMSADRSWLQEKVKIEKLQQKIQLALQHVLQKNHREDGILTKLICKVSTLRALCGRHTEKLMAFKAIYPDIVRLHFPPLYKELFTSEFEPAMQIDG

SEQ ID NO: 15584 - protein, 470 aa, Homo Sapiens
MCENQLKTKADATAQIEVIPCKICGDKSSGIHYGVITCEGCKGFFRRSQQNNASYSCPRQRNCLIDRTNRNRCQHCRLQKCLALGMSRDAVKFGRMSKKQRDSLYAEVQKHQQRLQEQRQQQSGEAEALARVYSSSISNGLSNLNNETSGTYANGHVIDLPKSEGYYNVDSGQPSPDQSGLDMTGIKQIKQEPIYDLTSVPNLFTYSSFNNGQLAPGITMTEIDRIAQNIIKSHLETCQYTMEELHQLAWQTHTYEEIKAYQSKSREALWQQCAIQITHAIQYVVEFAKRITGFMELCQNDQILLLKSGCLEVVLVRMCRAFNPLNNTVLFEGKYGGMQMFKALGSDDLVNEAFDFAKNLCSLQLTEEEIALFSSAVLISPDRAWLIEPRKVQKLQEKIYFALQHVIQKNHLDDETLAKLIAKIPTITAVCNLHGEKLQVFKQSHPEIVNTLFPPLYKELFNPDCATGCK

SEQ ID NO: 15585 - protein, 518 aa, Homo Sapiens
MDRAPQRQHRASRELLAAKKTHTSQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 15586 - protein, 497 aa, Homo Sapiens
MRTQIEVIPCKICGDKSSGIHYGVITCEGCKGFFRRSQRCNAAYSCTRQQNCPIDRTSRNRCQHCRLQKCLALGMSRDAVKFGRMSKKQRDSLHAEVQKQLQQRQQQQQEPVVKTPPAGAQGADTLTYTLGLPDGQLPLGSSPDLPEASACPPGLLKASGSGPSYSNNLAKAGLNGASCHLEYSPERGKAEGRESFYSTGSQLTPDRCGLRFEEHRHPGLGELGQGPDSYGSPSFRSTPEAPYASLTEIEHLVQSVCKSYRETCQLRLEDLLRQRSNIFSREEVTGYQRKSMWEMWERCAHHLTEAIQYVVEFAKRLSGFMELCQNDQIVLLKAGAMEVVLVRMCRAYNADNRTVFFEGKYGGMELFRALGCSELISSIFDFSHSLSALHFSEDEIALYTALVLINAHRPGLQEKRKVEQLQYNLELAFHHHLCKTHRQSILAKLPPKGKLRSLCSQHVERLQIFQHLHPIVVQAAFPPLYKELFSTETESPVGLSK

SEQ ID NO: 15587 - protein, 1687 aa, Homo Sapiens
MTSSSPAGLEGSDLSSINTMMSAVMSVGKVTENGGSPQGIKSPSKPPGPNRIGRRNQETKEEKSSYNCPLCEKICTTQHQLTMHIRQHNTDTGGADHSCSICGKSLSSASSLDRHMLVHSGERPYKCTVCGQSFTTNGNMHRHMKIHEKDPNSATATAPPSPLKRRRLSSKRKLSHDAESEREDPAPAKKMVEDGQSGDLEKKADEVFHCPVCFKEFVCKYGLETHMETHSDNPLRCDICCVTFRTHRGLLRHNALVHKQLPRDAMGRPFIQNNPSIPAGFHDLGFTDFSCRKFPRISQAWCETNLRRCISEQHRFVCDTCDKAFPMLCSLALHKQTHVAADQGQEKPQATPLPGDALDQKGFLALLGLQHTKDVRPAPAEEPLPDDNQAIQLQTLKCQLPQDPGCTNLLSLSPFEAASLGGSLTVLPATKDSIKHLSLQPFQKGFIIQPDSSIVVKPISGESAIELADIQQILKMAASAPPQISLPPFSKAPAAPLQAIFKHMPPLKPKPLVTPRTVVATSTPPPLINAQQASPGCISPSLPPPPLKLLKGSVEAASNAHLLQSKSGTQPHAATRLSLQQPRAELPGQPEMKTQLEQDSIIEALLPLSMEAKIKQEITEGELKAFMTAPGGKKTPAMRKVLYPCRFCNQVFAFSGVLRAHVRSHLGISPYQCNICDYIAADKAALIRHLRTHSGERPYICKICHYPFTVKANCERHLRKKHLKATRKDIEKNIEYVSSSAAELVDAFCAPDTVCRLCGEDLKHYRALRIHMRTHCGRGLGGGHKGRKPFECKECSAAFAAKRNCIHHILKQHLHVPEQDIESYVLAADGLGPAEAPAAEASGRGEDSGCAALGDCKPLTAFLEPQNGFLHRGPTQPPPPHVSIKLEPASSFAVDFNEPLDFSQKGLALVQVKQENISFLSPSSLVPYDCSMEPIDLSIPKNFRKGDKDLATPSEAKKPEEEAGSSEQPSPCPAPGPSLPVTLGPSGILESPMAPAPAATPEPPAQPLQGPVQLAVPIYSSALVSSPPLVGSSALLSGTALLRPLRPKPPLLLPKPPVTEELPPLASIAQIISSVSSAPTLLKTKVADPGPASTGSNTTASDSLGGSVPKAATTATPAATTSPKESSEPPAPASSPEAASPTEQGPAGTSKKRGRKRGMRSRPRANSGGVDLDSSGEFASIEKMLATTDTNKFSPFLQTAEDNTQDEVAGAPADHHGPSDEEQGSPPEDKLLRAKRNSYTNCLQKITCPHCPRVFPWASSLQRHMLTHTDSQSDAETAAAAGEVLDLTSRDREQPSEGATELRQVAGDAPVEQATAETASPVHREEHGRGESHEPEEEHGTEESTGDADGAEEDASSNQSLDLDFATKLMDFKLAEGDGEAGAGGAASQEQKLACDTCGKSFKFLGTLSRHRKAHGRQEPKDEKGDGASTAEEGPQPAPEQEEKPPETPAEVVESAPGAGEAPAEKLAEETEGPSDGESAAEKRSSEKSDDDKKPKTDSPKSVASKADKRKKVCSVCNKRFWSLQDLTRHMRSHTGERPYKCQTCERTFTLKHSLVRHQRIHQKARHAKHHGKDSDKEERGEEDSENESTHSGNNAVSENEAELAPNASNHMAVTRSRKEGLASATKDCSHREEKVTAGWPSEPGQGDLNPESPAALGQDLLEPRSKRPAHPILATADGASQLVGME

SEQ ID NO: 15588 - protein, 453 aa, Homo Sapiens
MRIPVDASTSRRFTPPSTALSPGKMSEALPLGAPDAGAALAGKLRSGDRSMVEVLADHPGELVRTDSPNFLCSVLPTHWRCNKTLPIAFKVVALGDVPDGTLVTVMAGNDENYSAELRNATAAMKNQVARFNDLRFVGRSGRGKSFTLTITVFTNPPQVATYHRAIKITVDGPREPRRHRQKLDDQTKPGSLSFSERLSELEQLRRTAMRVSPHHPAPTPNPRASLNHSTAFNPQPQSQMQDTRQIQPSPPWSYDQSYQYLGSIASPSVHPATPISPGRASGMTTLSAELSSRLSTAPDLTAFSDPRQFPALPSISDPRMHYPGAFTYSPTPVTSGIGIGMSAMGSATRYHTYLPPPYPGSSQAQGGPFQASSPSYHLYYGASAGSYQFSMVGGERSPPRILPPCTNASTGSALLNPSLPNQSDVVEAEGSHSNSPTNMAPSARLEEAVWRPY

SEQ ID NO: 15589 - protein, 604 aa, Homo Sapiens
MISVKRNTWRALSLVIGDCRKKGNFEYCQDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 15590 - protein, 521 aa, Homo Sapiens
MASNSLFSTVTPCQQNFFWDPSTSRRFSPPSSSLQPGKMSDVSPVVAAQQQQQQQQQQQQQQQQQQQQQQQEAAAAAAAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSGRGKSFTLTITVFTNPPQVATYHRAIKVTVDGPREPRRHRQKLDDSKPSLFSDRLSDLGRIPHPSMRVGVPPQNPRPSLNSAPSPFNPQGQSQITDPRQAQSSPPWSYDQSYPSYLSQMTSPSIHSTTPLSSTRGTGLPAITDVPRRISDDDTATSDFCLWPSTLSKKSQAGASELGPFSDPRQFPSISSLTESRFSNPRMHYPATFTYTPPVTSGMSLGMSATTHYHTYLPPPYPGSSQSQSGPFQTSSTPYLYYGTSSGSYQFPMVPGGDRSPSRMLPPCTTTSNGSTLLNPNLPNQNDGVDADGSHSSSPTVLNSSGRMDESVWRPY

SEQ ID NO: 15591 - protein, 415 aa, Homo Sapiens
MRIPVDPSTSRRFTPPSPAFPCGGGGGKMGENSGALSAQAAVGPGGRARPEVRSMVDVLADHAGELVRTDSPNFLCSVLPSHWRCNKTLPVAFKVVALGDVPDGTVVTVMAGNDENYSAELRNASAVMKNQVARFNDLRFVGRSGRGKSFTLTITVFTNPTQVATYHRAIKVTVDGPREPRRHRQKLEDQTKPFPDRFGDLERLRMRVTPSTPSPRGSLSTTSHFSSQPQTPIQGTSELNPFSDPRQFDRSFPTLPTLTESRFPDPRMHYPGAMSAAFPYSATPSGTSISSLSVAGMPATSRFHHTYLPPPYPGAPQNQSGPFQANPSPYHLYYGTSSGSYQFSMVAGSSSGGDRSPTRMLASCTSSAASVAAGNLMNPSLGGQSDGVEADGSHSNSPTALSTPGRMDEAVWRPY

SEQ ID NO: 15592 - protein, 462 aa, Homo Sapiens
MDTKHFLPLDFSTQVNSSLTSPTGRGSMAAPSLHPSLGPGIGSPGQLHSPISTLSSPINGMGPPFSVISSPMGPHSMSVPTTPTLGFSTGSPQLSSPMNPVSSSEDIKPPLGLNGVLKVPAHPSGNMASFTKHICAICGDRSSGKHYGVYSCEGCKGFFKRTVRKDLTYTCRDNKDCLIDKRQRNRCQYCRYQKCLAMGMKREAVQEERQRGKDRNENEVESTSSANEDMPVERILEAELAVEPKTETYVEANMGLNPSSPNDPVTNICQAADKQLFTLVEWAKRIPHFSELPLDDQVILLRAGWNELLIASFSHRSIAVKDGILLATGLHVHRNSAHSAGVGAIFDRVLTELVSKMRDMQMDKTELGCLRAIVLFNPDSKGLSNPAEVEALREKVYASLEAYCKHKYPEQPGRFAKLLLRLPALRSIGLKCLEHLFFFKLIGDTPIDTFLMEMLEAPHQMT

SEQ ID NO: 15593 - protein, 533 aa, Homo Sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRNRCQYCRYQKCLATGMKREAVQEERQRGKDKDGDGEGAGGAPEEMPVDRILEAELAVEQKSDQGVEGPGGTGGSGSSPNDPVTNICQAADKQLFTLVEWAKRIPHFSSLPLDDQVILLRAGWNELLIASFSHRSIDVRDGILLATGLHVHRNSAHSAGVGAIFDRVLTELVSKMRDMRMDKTELGCLRAIILFNPDAKGLSNPSEVEVLREKVYASLETYCKQKYPEQQGRFAKLLLRLPALRSIGLKCLEHLFFFKLIGDTPIDTFLMEMLEAPHQLA

SEQ ID NO: 15594 - protein, 463 aa, Homo Sapiens
MYGNYSHFMKFPAGYGGSPGHTGSTSMSPSAALSTGKPMDSHPSYTDTPVSAPRTLSAVGTPLNALGSPYRVITSAMGPPSGALAAPPGINLVAPPSSQLNVVNSVSSSEDIKPLPGLPGIGNMNYPSTSPGSLVKHICAICGDRSSGKHYGVYSCEGCKGFFKRTIRKDLIYTCRDNKDCLIDKRQRNRCQYCRYQKCLVMGMKREAVQEERQRSRERAESEAECATSGHEDMPVERILEAELAVEPKTESYGDMNMENSTNDPVTNICHAADKQLFTLVEWAKRIPHFSDLTLEDQVILLRAGWNELLIASFSHRSVSVQDGILLATGLHVHRSSAHSAGVGSIFDRVLTELVSKMKDMQMDKSELGCLRAIVLFNPDAKGLSNPSEVETLREKVYATLEAYTKQKYPEQPGRFAKLLLRLPALRSIGLKCLEHLFFFKLIGDTPIDTFLMEMLETPLQIT

SEQ ID NO: 15595 - protein, 1324 aa, Homo Sapiens
MSRRKQAKPQHFQSDPEVASLPRRDGDTEKGQPSRPTKSKDAHVCGRCCAEFFELSDLLLHKKNCTKNQLVLIVNENPASPPETFSPSPPPDNPDEQMNDTVNKTDQVDCSDLSEHNGLDREESMEVEAPVANKSGSGTSSGSHSSTAPSSSSSSSSSSGGGGSSSTGTSAITTSLPQLGDLTTLGNFSVINSNVIIENLQSTKVAVAQFSQEARCGGASGGKLAVPALMEQLLALQQQQIHQLQLIEQIRHQILLLASQNADLPTSSSPSQGTLRTSANPLSTLSSHLSQQLAAAAGLAQSLASQSASISGVKQLPPIQLPQSSSGNTIIPSNSGSSPNMNILAAAVTTPSSEKVASSAGASHVSNPAVSSSSSPAFAISSLLSPASNPLLPQQASANSVFPSPLPNIGTTAEDLNSLSALAQQRKSKPPNVTAFEAKSTSDEAFFKHKCRFCAKVFGSDSALQIHLRSHTGERPFKCNICGNRFSTKGNLKVHFQRHKEKYPHIQMNPYPVPEHLDNIPTSTGIPYGMSIPPEKPVTSWLDTKPVLPTLTTSVGLPLPPTLPSLIPFIKTEEPAPIPISHSATSPPGSVKSDSGGPESATRNLGGLPEEAEGSTLPPSGGKSEESGMVTNSVPTASSSVLSSPAADCGPAGSATTFTNPLLPLMSEQFKAKFPFGGLLDSAQASETSKLQQLVENIDKKATDPNECIICHRVLSCQSALKMHYRTHTGERPFKCKICGRAFTTKGNLKTHYSVHRAMPPLRVQHSCPICQKKFTNAVVLQQHIRMHMGGQIPNTPVPDSYSESMESDTGSFDEKNFDDLDNFSDENMEDCPEGSIPDTPKSADASQDSLSSSPLPLEMSSIAALENQMKMINAGLAEQLQASLKSVENGSIEGDVLTNDSSSVGGDMESQSAGSPAISESTSSMQALSPSNSTQEFHKSPSIEEKPQRAVPSEFANGLSPTPVNGGALDLTSSHAEKIIKEDSLGILFPFRDRGKFKNTACDICGKTFACQSALDIHYRSHTKERPFICTVCNRGFSTKGNLKQHMLTHQMRDLPSQLFEPSSNLGPNQNSAVIPANSLSSLIKTEVNGFVHVSPQDSKDTPTSHVPSGPLSSSATSPVLLPALPRRTPKQHYCNTCGKTFSSSSALQIHERTHTGEKPFACTICGRAFTTKGNLKVHMGTHMWNSTPARRGRRLSVDGPMTFLGGNPVKFPEMFQKDLAARSGSGDPSSFWNQYAAALSNGLAMKANEISVIQNGGIPPIPGSLGSGNSSPVSGLTGNLERLQNSEPNAPLAGLEKMASSENGTNFRFTRFVEDSKEIVTS

SEQ ID NO: 15596 - protein, 1007 aa, Homo Sapiens
MSRRKQRKPQQLISDCEGPSASENGDASEEDHPQVCAKCCAQFTDPTEFLAHQNACSTDPPVMVIIGGQENPNNSSASSEPRPEGHNNPQVMDTEHSNPPDSGSSVPTDPTWGPERRGEESPGHFLVAATGTAAGGGGGLILASPKLGATPLPPESTPAPPPPPPPPPPPGVGSGHLNIPLILEELRVLQQRQIHQMQMTEQICRQVLLLGSLGQTVGAPASPSELPGTGTASSTKPLLPLFSPIKPVQTSKTLASSSSSSSSSSGAETPKQAFFHLYHPLGSQHPFSAGGVGRSHKPTPAPSPALPGSTDQLIASPHLAFPSTTGLLAAQCLGAARGLEATASPGLLKPKNGSGELSYGEVMGPLEKPGGRHKCRFCAKVFGSDSALQIHLRSHTGERPYKCNVCGNRFTTRGNLKVHFHRHREKYPHVQMNPHPVPEHLDYVITSSGLPYGMSVPPEKAEEEAATPGGGVERKPLVASTTALSATESLTLLSTSAGTATAPGLPAFNKFVLMKAVEPKNKADENTPPGSEGSAISGVAESSTATRMQLSKLVTSLPSWALLTNHFKSTGSFPFPYVLEPLGASPSETSKLQQLVEKIDRQGAVAVTSAASGAPTTSAPAPSSSASSGPNQCVICLRVLSCPRALRLHYGQHGGERPFKCKVCGRAFSTRGNLRAHFVGHKASPAARAQNSCPICQKKFTNAVTLQQHVRMHLGGQIPNGGTALPEGGGAAQENGSEQSTVSGAGSFPQQQSQQPSPEEELSEEEEEEDEEEEEDVTDEDSLAGRGSESGGEKAISVRGDSEEASGAEEEVGTVAAAATAGKEMDSNEKTTQQSSLPPPPPPDSLDQPQPMEQGSSGVLGGKEEGGKPERSSSPASALTPEGEATSVTLVEELSLQEAMRKEPGESSSRKACEVCGQAFPSQAALEEHQKTHPKEGPLFTCVFCRQGFLERATLKKHMLLAHHQVQPFAPHGPQNIAALSLVPGCSPSITSTGLSPFPRKDDPTIP

SEQ ID NO: 15597 - protein, 1300 aa, Homo Sapiens
MSRRKQAKPQHLKSDEELLPPDGAPEHAAPGEGAEDADSGPESRSGGEETSVCEKCCAEFFKWADFLEHQRSCTKLPPVLIVHEDAPAPPPEDFPEPSPASSPSERAESEAAEEAGAEGAEGEARPVEKEAEPMDAEPAGDTRAPRPPPAAPAPPTPAYGAPSTNVTLEALLSTKVAVAQFSQGARAAGGSGAGGGVAAAAVPLILEQLMALQQQQIHQLQLIEQIRSQVALMQRPPPRPSLSPAAAPSAPGPAPSQLPGLAALPLSAGAPAAAIAGSGPAAPAAFEGAQPLSRPESGASTPGGPAEPSAPAAPSAAPAPAAPAPAPAPQSAASSQPQSASTPPALAPGSLLGAAPGLPSPLLPQTSASGVIFPNPLVSIAATANALDPLSALMKHRKGKPPNVSVFEPKASAEDPFFKHKCRFCAKVFGSDSALQIHLRSHTGERPFKCNICGNRFSTKGNLKVHFQRHKEKYPHIQMNPYPVPEYLDNVPTCSGIPYGMSLPPEKPVTTWLDSKPVLPTVPTSVGLQLPPTVPGAHGYADSPSATPASRSPQRPSPASSECASLSPGLNHVESGVSATAESPQSLLGGPPLTKAEPVSLPCTNARAGDAPVGAQASAAPTSVDGAPTSLGSPGLPAVSEQFKAQFPFGGLLDSMQTSETSKLQQLVENIDKKMTDPNQCVICHRVLSCQSALKMHYRTHTGERPFKCKICGRAFTTKGNLKTHFGVHRAKPPLRVQHSCPICQKKFTNAVVLQQHIRMHMGGQIPNTPLPEGFQDAMDSELAYDDKNAETLSSYDDDMDENSMEDDAELKDAATDPAKPLLSYAGSCPPSPPSVISSIAALENQMKMIDSVMSCQQLTGLKSVENGSGESDRLSNDSSSAVGDLESRSAGSPALSESSSSQALSPAPSNGESFRSKSPGLGAPEEPQEIPLKTERPDSPAAAPGSGGAPGRAGIKEEAPFSLLFLSRERGKCPSTVCGVCGKPFACKSALEIHYRSHTKERPFVCALCRRGCSTMGNLKQHLLTHRLKELPSQLFDPNFALGPSQSTPSLISSAAPTMIKMEVNGHGKAMALGEGPPLPAGVQVPAGPQTVMGPGLAPMLAPPPRRTPKQHNCQSCGKTFSSASALQIHERTHTGEKPFGCTICGRAFTTKGNLKVHMGTHMWNNAPARRGRRLSVENPMALLGGDALKFSEMFQKDLAARAMNVDPSFWNQYAAAITNGLAMKNNEISVIQNGGIPQLPVSLGGSALPPLGSMASGMDKARTGSSPPIVSLDKASSETAASRPFTRFIEDNKEIGIN

SEQ ID NO: 15598 - protein, 1053 aa, Homo Sapiens
MSRRKQAKPQHINSEEDQGEQQPQQQTPEFADAAPAAPAAGELGAPVNHPGNDEVASEDEATVKRLRREETHVCEKCCAEFFSISEFLEHKKNCTKNPPVLIMNDSEGPVPSEDFSGAVLSHQPTSPGSKDCHRENGGSSEDMKEKPDAESVVYLKTETALPPTPQDISYLAKGKVANTNVTLQALRGTKVAVNQRSADALPAPVPGANSIPWVLEQILCLQQQQLQQIQLTEQIRIQVNMWASHALHSSGAGADTLKTLGSHMSQQVSAAVALLSQKAGSQGLSLDALKQAKLPHANIPSATSSLSPGLAPFTLKPDGTRVLPNVMSRLPSALLPQAPGSVLFQSPFSTVALDTSKKGKGKPPNISAVDVKPKDEAALYKHKCKYCSKVFGTDSSLQIHLRSHTGERPFVCSVCGHRFTTKGNLKVHFHRHPQVKANPQLFAEFQDKVAAGNGIPYALSVPDPIDEPSLSLDSKPVLVTTSVGLPQNLSSGTNPKDLTGGSLPGDLQPGPSPESEGGPTLPGVGPNYNSPRAGGFQGSGTPEPGSETLKLQQLVENIDKATTDPNECLICHRVLSCQSSLKMHYRTHTGERPFQCKICGRAFSTKGNLKTHLGVHRTNTSIKTQHSCPICQKKFTNAVMLQQHIRMHMGGQIPNTPLPENPCDFTGSEPMTVGENGSTGAICHDDVIESIDVEEVSSQEAPSSSSKVPTPLPSIHSASPTLGFAMMASLDAPGKVGPAPFNLQRQGSRENGSVESDGLTNDSSSLMGDQEYQSRSPDILETTSFQALSPANSQAESIKSKSPDAGSKAESSENSRTEMEGRSSLPSTFIRAPPTYVKVEVPGTFVGPSTLSPGMTPLLAAQPRRQAKQHGCTRCGKNFSSASALQIHERTHTGEKPFVCNICGRAFTTKGNLKVHYMTHGANNNSARRGRKLAIENTMALLGTDGKRVSEIFPKEILAPSVNVDPVVWNQYTSMLNGGLAVKTNEISVIQSGGVPTLPVSLGATSVVNNATVSKMDGSQSGISADVEKPSATDGVPKHQFPHFLEENKIAVS

SEQ ID NO: 15599 - protein, 763 aa, Homo Sapiens; identical to SEQ ID NO: 11649

SEQ ID NO: 15600 - protein, 733 aa, Homo Sapiens
MERRSESPCLRDSPDRRSGSPDVKGPPPVKVARLEQNGSPMGARGRPNGAVAKAVGGLMIPVFCVVEQLDGSLEYDNREEHAEFVLVRKDVLFSQLVETALLALGYSHSSAAQAQGIIKLGRWNPLPLSYVTDAPDATVADMLQDVYHVVTLKIQLQSCSKLEDLPAEQWNHATVRNALKELLKEMNQSTLAKECPLSQSMISSIVNSTYYANVSATKCQEFGRWYKKYKKIKVERVERENLSDYCVLGQRPMHLPNMNQLASLGKTNEQSPHSQIHHSTPIRNQVPALQPIMSPGLLSPQLSPQLVRQQIAMAHLINQQIAVSRLLAHQHPQAINQQFLNHPPIPRAVKPEPTNSSVEVSPDIYQQVRDELKRASVSQAVFARVAFNRTQGLLSEILRKEEDPRTASQSLLVNLRAMQNFLNLPEVERDRIYQDERERSMNPNVSMVSSASSSPSSSRTPQAKTSTPTTDLPIKVDGANINITAAIYDEIQQEMKRAKVSQALFAKVAANKSQGWLCELLRWKENPSPENRTLWENLCTIRRFLNLPQHERDVIYEEESRHHHSERMQHVVQLPPEPVQVLHRQQSQPAKESSPPREEAPPPPPPTEDSCAKKPRSRTKISLEALGILQSFIHDVGLYPDQEAIHTLSAQLDLPKHTIIKFFQNQRYHVKHHGKLKEHLGSAVDVAEYKDEELLTESEENDSEEGSEEMYKVEAEEENADKSKAAPAEIDQR

SEQ ID NO: 15601 - protein, 1400 aa, Homo Sapiens
MMASFQRSNSHDKVRRIVAEEGRTARNLIAWSVPLESKDDDGKPKCQTGGKSKRTIQGTHKTTKQSTAVDCKITSSTTGDKHFDKSPTKTRHPRKIDLRARYWAFLFDNLRRAVDEIYVTCESDQSVVECKEVLMMLDNYVRDFKALIDWIQLQEKLEKTDAQSRPTSLAWEVKKMSPGRHVIPSPSTDRINVTSNARRSLNFGGSTGTVPAPRLAPTGVSWADKVKAHHTGSTASSEITPAQSCPPMTVQKASRKNERKDAEGWETVQRGRPIRSRSTAVMPKVSLATEATRSKDDSDKENVCLLPDESIQKGQFVGDGTSNTIESHPKDSLHSCDHPLAEKTQFTVSTLDDVKNSGSIRDNYVRTSEISAVHIDTECVSVMLQAGTPPLQVNEEKFPAEKARIENEMDPSDISNSMAEVLAKKEELADRLEKANEEAIASAIAEEEQLTREIEAEENNDINIETDNDSDFSASMGSGSVSFCGMSMDWNDVLADYEARESWRQNTSWGDIVEEEPARPPGHGIHMHEKLSSPSRKRTIAESKKKHEEKQMKAQQLREKLREEKTLKLQKLLEREKDVRKWKEELLDQRRRMMEEKLLHAEFKREVQLQAIVKKAQEEEAKVNEIAFINTLEAQNKRHDVLSKLKEYEQRLNELQEERQRRQEEKQARDEAVQERKRALEAERQARVEELLMKRKEQEARIEQQRQEKEKAREDAARERARDREERLAALTAAQQEAMEELQKKIQLKHDESIRRHMEQIEQRKEKAAELSSGRHANTDYAPKLTPYERKKQCSLCNVLISSEVYLFSHVKGRKHQQAVRENTSIQGRELSDEEVEHLSLKKYIIDIVVESTAPAEALKDGEERQKNKKKAKKIKARMNFRAKEYESLMETKNSGSDSPYKAKLQRLAKDLLKQVQVQDSGSWANNKVSALDRTLGEITRILEKENVADQIAFQAAGGLTALEHILQAVVPATNVNTVLRIPPKSLCNAINVYNLTCNNCSENCSDVLFSNKITFLMDLLIHQLTVYVPDENNTILGRNTNKQVFEGLTTGLLKVSAVVLGCLIANRPDGNCQPATPKIPTQEMKNKPSQGDPFNNRVQDLISYVVNMGLIDKLCACFLSVQGPVDENPKMAIFLQHAAGLLHAMCTLCFAVTGRSYSIFDNNRQDPTGLTAALQATDLAGVLHMLYCVLFHGTILDPSTASPKENYTQNTIQVAIQSLRFFNSFAALHLPAFQSIVGAEGLSLAFRHMASSLLGHCSQVSCESLLHEVIVCVGYFTVNHPDNQVIVQSGRHPTVLQKLCQLPFQYFSDPRLIKVLFPSLIAACYNNHQNKIILEQEMSCVLLATFIQDLAQTPGQAENQPYQPKGKCLGSQDYLELANRFPQQAWEEARQFFLKKEKK

SEQ ID NO: 15602 - protein, 348 aa, Homo Sapiens
MPRSFLVKKVKLDAFSSADLESAYGRARSDLGAPLHDKGYLSDYVGPSSVYDGDAEAALLKGPSPEPMYAAAVRGELGPAAAGSAPPPTPRPELATAAGGYINGDAAVSEGYAADAFFITDGRSRRKASNAGSAAAPSTASAAAPDGDAGGGGGAGGRSLGSGPGGRGGTRAGAGTEARAGPGAAGAGGRHACGECGKTYATSSNLSRHKQTHRSLDSQLARRCPTCGKVYVSMPAMAMHLLTHDLRHKCGVCGKAFSRPWLLQGHMRSHTGEKPFGCAHCGKAFADRSNLRAHMQTHSAFKHFQCKRCKKSFALKSYLNKHYESACFKGGAGGPAAPAPPQLSPVQA

SEQ ID NO: 15603 - protein, 307 aa, Homo Sapiens
MPRSFLVKKIKGDGFQCSGVPAPTYHPLETAYVLPGARGPPGDNGYAPHRLPPSSYDADQKPGLELAPAEPAYPPAAPEEYSDPESPQSSLSARYFRGEAAVTDSYSMDAFFISDGRSRRRRGGGGGDAGGSGDAGGAGGRAGRAGAQAGGGHRHACAECGKTYATSSNLSRHKQTHRSLDSQLARKCPTCGKAYVSMPALAMHLLTHNLRHKCGVCGKAFSRPWLLQGHMRSHTGEKPFGCAHCGKAFADRSNLRAHMQTHSAFKHYRCRQCDKSFALKSYLHKHCEAACAKAAEPPPPTPAGPAS

SEQ ID NO: 15604 - protein, 201 aa, Homo Sapiens
MSFATLRPAPPGRYLYPEVSPLSEDEDRGSDSSGSDEKPCRVHAARCGLQGARRRAGGRRAGGGGPGGRPGREPRQRHTANARERDRTNSVNTAFTALRTLIPTEPADRKLSKIETLRLASSYISHLGNVLLAGEACGDGQPCHSGPAFFHAARAGSPPPPPPPPPARDGENTQPKQICTFCLSNQRKLSKDRDRKTAIRS

SEQ ID NO: 15605 - protein, 216 aa, Homo Sapiens
MGGSGVGTAWHGPLARPSGTLPFASSMPSPVDASSADGGSGLGSHRRKRTTFSKGQLLELERAFAAWPYPNISTHEHLAWVTCLPEAKVQVWFQKRWAKIIKNRKSGILSPGSECPQSSCSLPDTLQQPWDPQMPGQPPPSSGTPQRTSVCRHSSCPAPGLSPRQGWEGAKAVAPWGSAGASEVHPSLERATPQTSLGSLSDLIYALAIVVNVDHS

SEQ ID NO: 15606 - protein, 1596 aa, Homo Sapiens
MESRETLSSSRQRGGESDFLPVSSAKPPAAPGCAGEPLLSTPGPGKGIPVGGERMEPEEEDELGSGRDVDSNSNADSEKWVAGDGLEEQEFSIKEANFTEGSLKLKIQTTKRAKKPPKNLENYICPPEIKITIKQSGDQKVSRAGKNSKATKEEERSHSKKKLLTASDLAASDLKGFQPQAYERPQKHSTLHYDTGLPQDFTGDTLKPKHQQKSSSQNHMDWSTNSDSGPVTQNCFISPESGRETASTSKIPALEPVASFAKAQGKKGSAGNTWSQLSNNNKDLLLGGVAPSPSSHSSPAPPSSSAECNGLQPLVDQDGGGTKEPPEPPTVGSKKKSSKKDVISQTIPNPDLDWVKNAQKAFDNTEGKREGYSADSAQEASPARQNVSSASNPENDSSHVRITIPIKAPSLDPTNHKRKKRQSIKAVVEKIMPEKALASGITMSSEVVNRILSNSEGNKKDPRVPKLSKMIENESPSVGLETGGNAEKVIPGGVSKPRKPPMVMTPPTCTDHSPSRKLPEIQHPKFAAKRRWTCSKPKPSTMLREAVMATSDKLMLEPPSAYPITPSSPLYTNTDSLTVITPVKKKRGRPKKQPLLTVETIHEGTSTSPVSPISREFPGTKKRKRRRNLAKLAQLVPGEDKPMSEMKFHKKVGKLGVLDKKTIKTINKMKTLKRKNILNQILSCSSSVALKAKAPPETSPGAAAIESKLGKQINVSKRGTIYIGKKRGRKPRAELPPPSEEPKTAIKHPRPVSSQPDVPAVPSNFQSLVASSPAAMHPLSTQLGGSNGNLSPASTETNFSELKTMPNLQPISALPTKTQKGIHSGTWKLSPPRLMANSPSHLCEIGSLKEITLSPVSESHSEETIPSDSGIGTDNNSTSDQAEKSSESRRRYSFDFCSLDNPEAIPSDTSTKNRHGHRQKHLIVDNFLAHESLKKPKHKRKRKSLQNRDDLQFLADLEELITKFQVFRISHRSYTFYHENPYPSIFRINFDHYYPVPYIQYDPLLYLRRTSDLKSKKKRGRPAKTNDTMTKVPFLQGFSYPIPSGSYYAPYGMPYTSMPMMNLGYYGQYPAPLYLSHTLGAASPFMRPTVPPPQFHTNSHVKMSGAAKHKAKHGVHLQGPVSMGLGDMQPSLNPPKVGSASLSSGRLHKRKHKHKHKHKEDRILGTHDNLSGLFAGKATGFSSHILSERLSSADKELPLVSEKNKHKEKQKHQHSEAGHKASKNNFEVDTLSTLSLSDAQHWTQAKEKGDLSSEPVDSCTKRYSGSGGDGGSTRSENLDVFSEMNPSNDKWDSDVSGSKRRSYEGFGTYREKDIQAFKMNRKERSSYDSSMSPGMPSPHLKVDQTAVHSKNEGSVPTMMTRKKPAAVDSVTIPPAPVLSLLAASAATSDAVGSSLKKRFKRREIEAIQCEVRKMCNYTKILSTKKNLDHVNKILKAKRLQRQSKTGNNFVKKRRGRPRKQPTQFDEDSRDQMPVLEKCIDLPSKRGQKPSLSPLVLEPAASQDTIMATIEAVIHMAREAPPLPPPPPPPLPPPPPPPLPPPPPLPKTPRGGKRKHKPQAPAQPPQQSPPQQPLPQEEEVKAKRQRKSRGSESEVLP

SEQ ID NO: 15607 - protein, 707 aa, Homo Sapiens
MSRDRFRSRGGGGGGFHRRGGGGGRGGLHDFRSPPPGMGLNQNRGPMGPGPGQSGPKPPIPPPPPHQQQQQPPPQQPPPQQPPPHQPPPHPQPHQQQQPPPPPQDSSKPVVAQGPGPAPGVGSAPPASSSAPPATPPTSGAPPGSGPGPTPTPPPAVTSAPPGAPPPTPPSSGVPTTPPQAGGPPPPPAAVPGPGPGPKQGPGPGGPKGGKMPGGPKPGGGPGLSTPGGHPKPPHRGGGEPRGGRQHHPPYHQQHHQGPPPGGPGGRSEEKISDSEGFKANLSLLRRPGEKTYTQRCRLFVGNLPADITEDEFKRLFAKYGEPGEVFINKGKGFGFIKLESRALAEIAKAELDDTPMRGRQLRVRFATHAAALSVRNLSPYVSNELLEEAFSQFGPIERAVVIVDDRGRSTGKGIVEFASKPAARKAFERCSEGVFLLTTTPRPVIVEPLEQLDDEDGLPEKLAQKNPMYQKERETPPRFAQHGTFEYEYSQRWKSLDEMEKQQREQVEKNMKDAKDKLESEMEDAYHEHQANLLRQDLMRRQEELRRMEELHNQEMQKRKEMQLRQEEERRRREEEMMIRQREMEEQMRRQREESYSRMGYMDPRERDMRMGGGGAMNMGDPYGSGGQKFPPLGGGGGIGYEANPGVPPATMSGSMMGSDMRTERFGQGGAGPVGGQGPRGMGPGTPAGYGRGREEYEGPNKKPRF

SEQ ID NO: 15608 - protein, 292 aa, Homo Sapiens
MEELTAFVSKSFDQKSKDGNGGGGGGGGKKDSITYREVLESGLARSRELGTSDSSLQDITEGGGHCPVHLFKDHVDNDKEKLKEFGTARVAEGIYECKEKREDVKSEDEDGQTKLKQRRSRTNFTLEQLNELERLFDETHYPDAFMREELSQRLGLSEARVQVWFQNRRAKCRKQENQMHKGVILGTANHLDACRVAPYVNMGALRMPFQQVQAQLQLEGVAHAHPHLHPHLAAHAPYLMFPPPPFGLPIASLAESASAAAVVAAAAKSNSKNSSIADLRLKARKHAEALGL

SEQ ID NO: 15609 - protein, 331 aa, Homo Sapiens
MEELTAFVSKSFDQKVKEKKEAITYREVLESGPLRGAKEPTGCTEAGRDDRSSPAVRAAGGGGGGGGGGGGGGGGGGVGGGGAGGGAGGGRSPVRELDMGAAERSREPGSPRLTEVSPELKDRKEDAKGMEDEGQTKIKQRRSRTNFTLEQLNELERLFDETHYPDAFMREELSQRLGLSEARVQVWFQNRRAKCRKQENQLHKGVLIGAASQFEACRVAPYVNVGALRMPFQQDSHCNVTPLSFQVQAQLQLDSAVAHAHHHLHPHLAAHAPYMMFPAPPFGLPLATLAADSASAASVVAAAAAAKTTSKNSSIADLRLKAKKHAAALGL

SEQ ID NO: 15610 - protein, 766 aa, Homo Sapiens
MKEKSKNAARTRREKENSEFYELAKLLPLPSAITSQLDKASIIRLTTSYLKMRVVFPEGLGEAWGHSSRTSPLDNVGRELGSHLLQTLDGFIFVVAPDGKIMYISETASVHLGLSQVELTGNSIYEYIHPADHDEMTAVLTAHQPYHSHFVQEYEIERSFFLRMKCVLAKRNAGLTCGGYKVIHCSGYLKIRQYSLDMSPFDGCYQNVGLVAVGHSLPPSAVTEIKLHSNMFMFRASLDMKLIFLDSRVAELTGYEPQDLIEKTLYHHVHGCDTFHLRCAHHLLLVKGQVTTKYYRFLAKHGGWVWVQSYATIVHNSRSSRPHCIVSVNYVLTDTEYKGLQLSLDQISASKPAFSYTSSSTPTMTDNRKGAKSRLSSSKSKSRTSPYPQYSGFHTERSESDHDSQWGGSPLTDTASPQLLDPADRPGSQHDASCAYRQFSDRSSLCYGFALDHSRLVEERHFHTQACEGGRCEAGRYFLGTPQAGREPWWGSRAALPLTKASPESREAYENSMPHIASVHRIHGRGHWDEDSVVSSPDPGSASESGDRYRTEQYQSSPHEPSKIETLIRATQQMIKEEENRLQLRKAPSDQLASINGAGKKHSLCFANYQQPPPTGEVCHGSALANTSPCDHIQQREGKMLSPHENDYDNSPTALSRISSPNSDRISKSSLILAKDYLHSDISPHQTAGDHPTVSPNCFGSHRQYFDKHAYTLTGYALEHLYDSETIRNYSLGCNGSHFDVTSHLRMQPDPAQGHKGTSVIITNGS

SEQ ID NO: 15611 - protein, 667 aa, Homo Sapiens
MKEKSKNAAKTRREKENGEFYELAKLLPLPSAITSQLDKASIIRLTTSYLKMRAVFPEGLGDAWGQPSRAGPLDGVAKELGSHLLQTLDGFVFVVASDGKIMYISETASVHLGLSQVELTGNSIYEYIHPSDHDEMTAVLTAHQPLHHHLLQEYEIERSFFLRMKCVLAKRNAGLTCSGYKVIHCSGYLKIRQYMLDMSLYDSCYQIVGLVAVGQSLPPSAITEIKLYSNMFMFRASLDLKLIFLDSRVTEVTGYEPQDLIEKTLYHHVHGCDVFHLRYAHHLLLVKGQVTTKYYRLLSKRGGWVWVQSYATVVHNSRSSRPHCIVSVNYVLTEIEYKELQLSLEQVSTAKSQDSWRTALSTSQETRKLVKPKNTKMKTKLRTNPYPPQQYSSFQMDKLECGQLGNWRASPPASAAAPPELQPHSESSDLLYTPSYSLPFSYHYGHFPLDSHVFSSKKPMLPAKFGQPQGSPCEVARFFLSTLPASGECQWHYANPLVPSSSSPAKNPPEPPANTARHSLVPSYEAPAAAVRRFGEDTAPPSFPSCGHYREEPALGPAKAARQAARDGARLALARAAPECCAPPTPEAPGAPAQLPFVLLNYHRVLARRGPLGGAAPAASGLACAPGGPEAATGALRLRHPSPAATSPPGAPLPHYLGASVIITNGR

SEQ ID NO: 15612 - protein, 284 aa, Homo Sapiens
MSMLPSFGFTQEQVACVCEVLQQGGNLERLGRFLWSLPACDHLHKNESVLKAKAVVAFHRGNFRELYKILESHQFSPHNHPKLQQLWLKAHYVEAEKLRGRPLGAVGKYRVRRKFPLPRTIWDGEETSYCFKEKSRGVLREWYAHNPYPSPREKRELAEATGLTTTQVSNWFKNRRQRDRAAEAKERENTENNNSSSNKQNQLSPLEGGKPLMSSSEEEFSPPQSPDQNSVLLLQGNMGHARSSNYSLPGLTASQPSHGLQTHQHQLQDSLLGPLTSSLVDLGS

SEQ ID NO: 15613 - protein, 291 aa, Homo Sapiens
MSMLPTFGFTQEQVACVCEVLQQGGNIERLGRFLWSLPACEHLHKNESVLKAKAVVAFHRGNFRELYKILESHQFSPHNHAKLQQLWLKAHYIEAEKLRGRPLGAVGKYRVRRKFPLPRSIWDGEETSYCFKEKSRSVLREWYAHNPYPSPREKRELAEATGLTTTQVSNWFKNRRQRDRAAEAKERENNENSNSNSHNPLNGSGKSVLGSSEDEKTPSGTPDHSSSSPALLLSPPPPGLPSLHSLGHPPGPSAVPVPVPGGGGADPLQHHHGLQDSILNPMSANLVDLGS

SEQ ID NO: 15614 - protein, 332 aa, Homo Sapiens
MVFRSPLDLYSSHFLLPNFADSHHRSILLASSGGGNGAGGGGGAGGGSGGGNGAGGGGAGGAGGGGGGGSRAPPEELSMFQLPTLNFSPEQVASVCETLEETGDIERLGRFLWSLPVAPGACEAINKHESILRARAVVAFHTGNFRDLYHILENHKFTKESHGKLQAMWLEAHYQEAEKLRGRPLGPVDKYRVRKKFPLPRTIWDGEQKTHCFKERTRSLLREWYLQDPYPNPSKKRELAQATGLTPTQVGNWFKNRRQRDRAAAAKNRLQHQAIGPSGMRSLAEPGCPTHGSAESPSTAASPTTSVSSLTERADTGTSILSVTSSDSECDV

SEQ ID NO: 15615 - protein, 781 aa, Homo Sapiens
MSSSSPTGQIASAADIKQENGMESASEGQEAHREVAGGAAVGLSPPAPAPFPLEPGDAATAAARVSGEEGAVAAAAAGAAADQVQLHSELLGRHHHAAAAAAQTPLAFSPDHVACVCEALQQGGNLDRLARFLWSLPQSDLLRGNESLLKARALVAFHQGIYPELYSILESHSFESANHPLLQQLWYKARYTEAERARGRPLGAVDKYRLRRKFPLPRTIWDGEETVYCFKEKSRNALKELYKQNRYPSPAEKRHLAKITGLSLTQVSNWFKNRRQRDRNPSETQSKSESDGNPSTEDESSKGHEDLSPHPLSSSSDGITNLSLSSHMEPVYMQQIGNAKISLSSSGVLLNGSLVPASTSPVFLNGNSFIQGPSGVILNGLNVGNTQAVALNPPKMSSNIVSNGISMTDILGSTSQDVKEFKVLQSSANSATTTSYSPSVPVSFPGLIPSTEVKREGIQTVASQDGGSVVTFTTPVQINQYGIVQIPNSGANSQFLNGSIGFSPLQLPPVSVAASQGNISVSSSTSDGSTFTSESTTVQQGKVFLSSLAPSAVVYTVPNTGQTIGSVKQEGLERSLVFSQLMPVNQNAQVNANLSSENISGSGLHPLASSLVNVSPTHNFSLSPSTLLNPTELNRDIADSQPMSAPVASKSTVTSVSNTNYATLQNCSLITGQDLLSVPMTQAALGEIVPTAEDQVGHPSPAVHQDFVQEHRLVLQSVANMKENFLSNSESKATSSLMMLDSKSKYVLDGMVDTVCEDLETDKKELAKLQTVQLDEDMQDL

SEQ ID NO: 15616 - protein, 739 aa, Homo Sapiens
MATLPAEPSAGPAAGGEAVAAAAATEEEEEEARQLLQTLQAAEGEAAAAAGAGAGAAAAGAEGPGSPGVPGSPPEAASEPPTGLRFSPEQVACVCEALLQAGHAGRLSRFLGALPPAERLRGSDPVLRARALVAFQRGEYAELYRLLESRPFPAAHHAFLQDLYLRARYHEAERARGRALGAVDKYRLRKKFPLPKTIWDGEETVYCFKERSRAALKACYRGNRYPTPDEKRRLATLTGLSLTQVSNWFKNRRQRDRTGAGGGAPCKSESDGNPTTEDESSRSPEDLERGAAPVSAEAAAQGSIFLAGTGPPAPCPASSSILVNGSFLAASGSPAVLLNGGPVIINGLALGEASSLGPLLLTGGGGAPPPQPSPQGASETKTSLVLDPQTGEVRLEEAQSEAPETKGAQVAAPGPALGEEVLGPLAQVVPGPPTAATFPLPPGPVPAVAAPQVVPLSPPPGYPTGLSPTSPLLNLPQVVPTSQVVTLPQAVGPLQLLAAGPGSPVKVAAAAGPANVHLINSGVGVTALQLPSATAPGNFLLANPVSGSPIVTGVALQQGKIILTATFPTSMLVSQVLPPAPGLALPLKPETAISVPEGGLPVAPSPALPEAHALGTLSAQQPPPAAATTSSTSLPFSPDSPGLLPNFPAPPPEGLMLSPAAVPVWSAGLELSAGTEGLLEAEKGLGTQAPHTVLRLPDPDPEGLLLGATAGGEVDEGLEAEAKVLTQLQSVPVEEPLEL

SEQ ID NO: 15617 - protein, 246 aa, Homo Sapiens
MFQLPILNFSPQQVAGVCETLEESGDVERLGRFLWSLPVAPAACEALNKNESVLRARAIVAFHGGNYRELYHILENHKFTKESHAKLQALWLEAHYQEAEKLRGRPLGPVDKYRVRKKFPLPRTIWDGEQKTHCFKERTRHLLREWYLQDPYPNPSKKRELAQATGLTPTQVGNWFKNRRQRDRAAAAKNRLQQQVLSQGSGRALRAEGDGTPEVLGVATSPAASLSSKAATSAISITSSDSECDI

SEQ ID NO: 15618 - protein, 728 aa, Homo Sapiens
MEAAAGGRGCFQPHPGLQKTLEQFHLSSMSSLGGPAAFSARWAQEAYKKESAKEAGAAAVPAPVPAATEPPPVLHLPAIQPPPPVLPGPFFMPSDRSTERCETVLEGETISCFVVGGEKRLCLPQILNSVLRDFSLQQINAVCDELHIYCSRCTADQLEILKVMGILPFSAPSCGLITKTDAERLCNALLYGGAYPPPCKKELAASLALGLELSERSVRVYHECFGKCKGLLVPELYSSPSAACIQCLDCRLMYPPHKFVVHSHKALENRTCHWGFDSANWRAYILLSQDYTGKEEQARLGRCLDDVKEKFDYGNKYKRRVPRVSSEPPASIRPKTDDTSSQSPAPSEKDKPSSWLRTLAGSSNKSLGCVHPRQRLSAFRPWSPAVSASEKELSPHLPALIRDSFYSYKSFETAVAPNVALAPPAQQKVVSSPPCAAAVSRAPEPLATCTQPRKRKLTVDTPGAPETLAPVAAPEEDKDSEAEVEVESREEFTSSLSSLSSPSFTSSSSAKDLGSPGARALPSAVPDAAAPADAPSGLEAELEHLRQALEGGLDTKEAKEKFLHEVVKMRVKQEEKLSAALQAKRSLHQELEFLRVAKKEKLREATEAKRNLRKEIERLRAENEKKMKEANESRLRLKRELEQARQARVCDKGCEAGRLRAKYSAQIEDLQVKLQHAEADREQLRADLLREREAREHLEKVVKELQEQLWPRARPEAAGSEGAAELEP

SEQ ID NO: 15619 - protein, 684 aa, Homo Sapiens
MENLQTNFSLVQGSTKKLNGMGDDGSPPAKKMITDIHANGKTINKVPTVKKEHLDDYGEAPVETDGEHVKRTCTSVPETLHLNPSLKHTLAQFHLSSQSSLGGPAAFSARHSQESMSPTVFLPLPSPQVLPGPLLIPSDSSTELTQTVLEGESISCFQVGGEKRLCLPQVLNSVLREFTLQQINTVCDELYIYCSRCTSDQLHILKVLGILPFNAPSCGLITLTDAQRLCNALLRPRTFPQNGSVLPAKSSLAQLKETGSAFEVEHECLGKCQGLFAPQFYVQPDAPCIQCLECCGMFAPQTFVMHSHRSPDKRTCHWGFESAKWHCYLHVNQKYLGTPEEKKLKIILEEMKEKFSMRSGKRNQSKTDAPSGMELQSWYPVIKQEGDHVSQTHSFLHPSYYLYMCDKVVAPNVSLTSAVSQSKELTKTEASKSISRQSEKAHSSGKLQKTVSYPDVSLEEQEKMDLKTSRELCSRLDASISNNSTSKRKSESATCNLVRDINKVGIGLVAAASSPLLVKDVICEDDKGKIMEEVMRTYLKQQEKLNLILQKKQQLQMEVKMLSSSKSMKELTEEQQNLQKELESLQNEHAQRMEEFYVEQKDLEKKLEQIMKQKCTCDSNLEKDKEAEYAGQLAELRQRLDHAEADRQELQDELRQEREARQKLEMMIKELKLQILKSSKTAKE

SEQ ID NO: 15620 - protein, 965 aa, Homo Sapiens
MALLCGLGQVTLRIWVSLPSQSENGIGFLAARAFLRSGGMEALTTQLGPGREGSSSPNSKQELQPYSGSSALKPNQVGETSLYGVPIVSLVIDGQERLCLAQISNTLLKNYSYNEIHNRRVALGITCVQCTPVQLEILRRAGAMPISSRRCGMITKREAERLCKSFLGEHKPPKLPENFAFDVVHECAWGSRGSFIPARYNSSRAKCIKCGYCSMYFSPNKFIFHSHRTPDAKYTQPDAANFNSWRRHLKLSDKSATDELSHAWEDVKAMFNGGTRKRTFSLQGGGGGGANGGSGGQGKGGAGGGGGGGPGCGAEMAPGPPPHKSLRCGEDEAAGPPGPPPPHPQRGLGLATGASGPAGPGGPGGGAGVRSYPVIPVPSKGFGLLQKLPPPLFPHPYGFPTAFGLCPKKDDPVLGAGEPKGGPGTGSGGGGAGTGGGAGGPGASHLPPGAGAGPGGGAMFWGHQPSGAAKDAAAVAAAAAAATVYPTFPMFWPAAGSLPVPSYPAAQSQAKAVAAAVAAAAAAAAAAAGSGAPEPLDGAEPAKESGLGAEERCPSALSRGPLDEDGTDEALPPPLAPLPPPPPPPARKGSYVSAFRPVVKDTESIAKLYGSAREAYGAGPARGPGPGAGSGGYVSPDFLSEGSSSYNSASPDVDTADEPEVDVESNRFPDDEDAQEETEPSAPSAGGGPDGEQPTGPPSATSSGADGPANSPDGGSPRPRRRLGPPPAGRPAFGDLAAEDLVRRPERSPPSGGGGYELREPCGPLGGPAPAKVFAPERDEHVKSAAVALGPAASYVCTPEAHEPDKEDNHSPADDLETRKSYPDQRSISQPSPANTDRGEDGLTLDVTGTHLVEKDIENLAREELQKLLLEQMELRKKLEREFQSLKDNFQDQMKRELAYREEMVQQLQIVRDTLCNELDQERKARYAIQQKLKEAHDALHHFSCKMLTPRHCTGNCSFKPPLLP

SEQ ID NO: 15621 - protein, 1001 aa, Homo Sapiens
MASSPLPGPNDILLASPSSAFQPDTLSQPRPGHANLKPNQVGQVILYGIPIVSLVIDGQERLCLAQISNTLLKNFSYNEIHNRRVALGITCVQCTPVQLEILRRAGAMPISSRRCGMITKREAERLCKSFLGENRPPKLPDNFAFDVSHECAWGCRGSFIPARYNSSRAKCIKCSYCNMYFSPNKFIFHSHRTPDAKYTQPDAANFNSWRRHLKLTDKSPQDELVFAWEDVKAMFNGGSRKRALPQPGAHPACHPLSSVKAAAVAAAAAVAGGGGLLGPHLLGAPPPPPPPPPPLAELAGAPHAHHKRPRFDDDDDSLQEAAVVAAASLSAAAASLSVAAASGGAGTGGGGAGGGCVAGVGVGAGAGAGAGAGAKGPRSYPVIPVPSKGSFGGVLQKFPGCGGLFPHPYTFPAAAAAFSLCHKKEDAGAAAEALGGAGAGGAGAAPKAGLSGLFWPAGRKDAFYPPFCMFWPPRTPGGLPVPTYLQPPPQPPSALGCALGESPALLRQAFLDLAEPGGAAGSAEAAPPPGQPPQVVANGPGSGPPPPAGGAGSRDALFESPPGGSGGDCSAGSTPPADSVAAAGAGAAAAGSGPAGSRVPAPHHPHLLEGRKAGGGSYHHSSAFRPVGGKDDAESLAKLHGASAGAPHSAQTHPHHHHHPHHHHHHHHPPQPPSPLLLLPPQPDEPGSERHHPAPPPPPPPPPPPPLAQHPHHRGLLSPGGTSCCYPSEDSSEDEDDEEEEQEVDVEGHKPPEGEEEEEGRDPDDDEEEDEETEVLLGDPLVGGGRFLQGRGPSEKGSSRDRAPAVAGAFPLGLNSSRLLQEDGKLGDPGSDLPPPPPPPLAPQKASGGGSSSPGSPVHHPSLEEQPSYKDSQKTKENNQVIVSTKDDNSFSDKNKEHSFFITDSDASGGDFWRERSGEHTQETNSPHSLKKDVENMGKEELQKVLFEQIDLRRRLEQEFQVLKGNTSFPVFNNFQDQMKRELAYREEMVQQLQIVSCIST

SEQ ID NO: 15622 - protein, 568 aa, Homo Sapiens
MLPGLAAAAAHRCSWSSLCRLRLRCRAAACNPSDRQEWQNLVTFGSFSNMVPCSHPYIGTLSQVKLYSTNVQKEGQGSQTLRVEKVPSFETAEGIGTELKAPLKQEPLQVRVKAVLKKREYGSKYTQNNFITGVRAINEFCLKSSDLEQLRKIRRRSPHEDTESFTVYLRSDVEAKSLEVWGSPEALAREKKLRKEAEIEYRERLFRNQKILREYRDFLGNTKPRSRTASVFFKGPGKVVMVAICINGLNCFFKFLAWIYTGSASMFSEAIHSLSDTCNQGLLALGISKSVQTPDPSHPYGFSNMRYISSLISGVGIFMMGAGLSWYHGVMGLLHPQPIESLLWAYCILAGSLVSEGATLLVAVNELRRNARAKGMSFYKYVMESRDPSTNVILLEDTAAVLGVIIAATCMGLTSITGNPLYDSLGSLGVGTLLGMVSAFLIYTNTEALLGRSIQPEQVQRLTELLENDPSVRAIHDVKATDLGLGKVRFKAEVDFDGRVVTRSYLEKQDFDQMLQEIQEVKTPEELETFMLKHGENIIDTLGAEVDRLEKELKKRNPEVRHVDLEIL

SEQ ID NO: 15623 - protein, 465 aa, Homo Sapiens
MNVTSLFSFTSPAVKRLLGWKQGDEEEKWAEKAVDALVKKLKKKKGAMEELEKALSCPGQPSNCVTIPRSLDGRLQVSHRKGLPHVIYCRVWRWPDLQSHHELKPLECCEFPFGSKQKEVCINPYHYKRVESPVLPPVLVPRHSEYNPQHSLLAQFRNLGQNEPHMPLNATFPDSFQQPNSHPFPHSPNSSYPNSPGSSSSTYPHSPTSSDPGSPFQMPADTPPPAYLPPEDPMTQDGSQPMDTNMMAPPLPSEINRGDVQAVAYEEPKHWCSIVYYELNNRVGEAFHASSTSVLVDGFTDPSNNKNRFCLGLLSNVNRNSTIENTRRHIGKGVHLYYVGGEVYAECLSDSSIFVQSRNCNYHHGFHPTTVCKIPSGCSLKIFNNQEFAQLLAQSVNHGFETVYELTKMCTIRMSFVKGWGAEYHRQDVTSTPCWIEIHLHGPLQWLDKVLTQMGSPHNPISSVS

SEQ ID NO: 15624 - protein, 467 aa, Homo Sapiens
MSSILPFTPPVVKRLLGWKKSAGGSGGAGGGEQNGQEEKWCEKAVKSLVKKLKKTGRLDELEKAITTQNCNTKCVTIPSTCSEIWGLSTPNTIDQWDTTGLYSFSEQTRSLDGRLQVSHRKGLPHVIYCRLWRWPDLHSHHELKAIENCEYAFNLKKDEVCVNPYHYQRVETPVLPPVLVPRHTEILTELPPLDDYTHSIPENTNFPAGIEPQSNYIPETPPPGYISEDGETSDQQLNQSMDTGSPAELSPTTLSPVNHSLDLQPVTYSEPAFWCSIAYYELNQRVGETFHASQPSLTVDGFTDPSNSERFCLGLLSNVNRNATVEMTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSVRCSSMS

SEQ ID NO: 15625 - protein, 425 aa, Homo Sapiens
MSSILPFTPPIVKRLLGWKKGEQNGQEEKWCEKAVKSLVKKLKKTGQLDELEKAITTQNVNTKCITIPRSLDGRLQVSHRKGLPHVIYCRLWRWPDLHSHHELRAMELCEFAFNMKKDEVCVNPYHYQRVETPVLPPVLVPRHTEIPAEFPPLDDYSHSIPENTNFPAGIEPQSNIPETPPPGYLSEDGETSDHQMNHSMDAGSPNLSPNPMSPAHNNLDLQPVTYCEPAFWCSISYYELNQRVGETFHASQPSMTVDGFTDPSNSERFCLGLLSNVNRNAAVELTRRHIGRGVRLYYIGGEVFAECLSDSAIFVQSPNCNQRYGWHPATVCKIPPGCNLKIFNNQEFAALLAQSVNQGFEAVYQLTRMCTIRMSFVKGWGAEYRRQTVTSTPCWIELHLNGPLQWLDKVLTQMGSPSIRCSSVS

SEQ ID NO: 15626 - protein, 552 aa, Homo Sapiens
MDNMSITNTPTSNDACLSIVHSLMCHRQGGESETFAKRAIESLVKKLKEKKDELDSLITAITTNGAHPSKCVTIQRTLDGRLQVAGRKGFPHVIYARLWRWPDLHKNELKHVKYCQYAFDLKCDSVCVNPYHYERVVSPGIDLSGLTLQSNAPSSMMVKDEYVHDFEGQPSLSTEGHSIQTIQHPPSNRASTETYSTPALLAPSESNATSTANFPNIPVASTSQPASILGGSHSEGLLQIASGPQPGQQQNGFTGQPATYHHNSTTTWTGSRTAPYTPNLPHHQNGHLQHHPPMPPHPGHYWPVHNELAFQPPISNHPAPEYWCSIAYFEMDVQVGETFKVPSSCPIVTVDGYVDPSGGDRFCLGQLSNVHRTEAIERARLHIGKGVQLECKGEGDVWVRCLSDHAVFVQSYYLDREAGRAPGDAVHKIYPSAYIKVFDLRQCHRQMQQQAATAQAAAAAQAAAVAGNIPGPGSVGGIAPAISLSAAAGIGVDDLRRLCILRMSFVKGWGPDYPRQSIKETPCWIEIHLHRALQLLDEVLHTMPIADPQPLD

SEQ ID NO: 15627 - protein, 465 aa, Homo Sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRDVQPVAYEEPKHWCSIVYYELNNRVGEAFHASSTSVLVDGFTDPSNNKSRFCLGLLSNVNRNSTIENTRRHIGKGVHLYYVGGEVYAECLSDSSIFVQSRNCNFHHGFHPTTVCKIPSSCSLKIFNNQEFAQLLAQSVNHGFEAVYELTKMCTIRMSFVKGWGAEYHRQDVTSTPCWIEIHLHGPLQWLDKVLTQMGSPLNPISSVS

SEQ ID NO: 15628 - protein, 496 aa, Homo Sapiens
MFRSKRSGLVRRLWRSRVVPDREEGGSGGGGGGDEDGSLGSRAEPAPRAREGGGCGRSEVRPVAPRRPRDAVGQRGAQGAGRRRRAGGPPRPMSEPGAGAGSSLLDVAEPGGPGWLPESDCETVTCCLFSERDAAGAPRDASDPLAGAALEPAGGGRSREARSRLLLLEQELKTVTYSLLKRLKERSLDTLLEAVESRGGVPGGCVLVPRADLRLGGQPAPPQLLLGRLFRWPDLQHAVELKPLCGCHSFAAAADGPTVCCNPYHFSRLCGPESPPPPYSRLSPRDEYKPLDLSDSTLSYTETEATNSLITAPGEFSDASMSPDATKPSHWCSVAYWEHRTRVGRLYAVYDQAVSIFYDLPQGSGFCLGQLNLEQRSESVRRTRSKIGFGILLSKEPDGVWAYNRGEHPIFVNSPTLDAPGGRALVVRKVPPGYSIKVFDFERSGLQHAPEPDAADGPYDPNSVRISFAKGWGPCYSRQFITSCPCWLEILLNNPR

SEQ ID NO: 15629 - protein, 426 aa, Homo Sapiens
MFRTKRSALVRRLWRSRAPGGEDEEEGAGGGGGGGELRGEGATDSRAHGAGGGGPGRAGCCLGKAVRGAKGHHHPHPPAAGAGAAGGAEADLKALTHSVLKKLKERQLELLLQAVESRGGTRTACLLLPGRLDCRLGPGAPAGAQPAQPPSSYSLPLLLCKVFRWPDLRHSSEVKRLCCCESYGKINPELVCCNPHHLSRLCELESPPPPYSRYPMDFLKPTADCPDAVPSSAETGGTNYLAPGGLSDSQLLLEPGDRSHWCVVAYWEEKTRVGRLYCVQEPSLDIFYDLPQGNGFCLGQLNSDNKSQLVQKVRSKIGCGIQLTREVDGVWVYNRSSYPIFIKSATLDNPDSRTLLVHKVFPGFSIKAFDYEKAYSLQRPNDHEFMQQPWTGFTVQISFVKGWGQCYTRQFISSCPCWLEVIFNSR

SEQ ID NO: 15630 - protein, 467 aa, Homo Sapiens
MHSTTPISSLFSFTSPAVKRLLGWKQGDEEEKWAEKAVDSLVKKLKKKKGAMDELERALSCPGQPSKCVTIPRSLDGRLQVSHRKGLPHVIYCRVWRWPDLQSHHELKPLECCEFPFGSKQKEVCINPYHYRRVETPVLPPVLVPRHSEYNPQLSLLAKFRSASLHSEPLMPHNATYPDSFQQPPCSALPPSPSHAFSQSPCTASYPHSPGSPSEPESPYQHSVDTPPLPYHATEASETQSGQPVDATADRHVVLSIPNGDFRPVCYEEPQHWCSVAYYELNNRVGETFQASSRSVLIDGFTDPSNNRNRFCLGLLSNVNRNSTIENTRRHIGKGVHLYYVGGEVYAECVSDSSIFVQSRNCNYQHGFHPATVCKIPSGCSLKVFNNQLFAQLLAQSVHHGFEVVYELTKMCTIRMSFVKGWGAEYHRQDVTSTPCWIEIHLHGPLQWLDKVLTQMGSPHNPISSVS

SEQ ID NO: 15631 - protein, 1054 aa, Homo Sapiens
MEQDTAAVAATVAAADATATIVVIEDEQPGPSTSQEEGAAAAATEATAATEKGEKKKEKNVSSFQLKLAAKAPKSEKEMDPEYEEKMKADRAKRFEFLLKQTELFAHFIQPSAQKSPTSPLNMKLGRPRIKKDEKQSLISAGDYRHRRTEQEEDEELLSESRKTSNVCIRFEVSPSYVKGGPLRDYQIRGLNWLISLYENGVNGILADEMGLGKTLQTIALLGYLKHYRNIPGPHMVLVPKSTLHNWMNEFKRWVPSLRVICFVGDKDARAAFIRDEMMPGEWDVCVTSYEMVIKEKSVFKKFHWRYLVIDEAHRIKNEKSKLSEIVREFKSTNRLLLTGTPLQNNLHELWALLNFLLPDVFNSADDFDSWFDTKNCLGDQKLVERLHAVLKPFLLRRIKTDVEKSLPPKKEIKIYLGLSKMQREWYTKILMKDIDVLNSSGKMDKMRLLNILMQLRKCCNHPYLFDGAEPGPPYTTDEHIVSNSGKMVVLDKLLAKLKEQGSRVLIFSQMTRLLDILEDYCMWRGYEYCRLDGQTPHEEREDKFLEVEFLGQREAIEAFNAPNSSKFIFMLSTRAGGLGINLASADVVILYDSDWNPQVDLQAMDRAHRIGQKKPVRVFRLITDNTVEERIVERAEIKLRLDSIVIQQGRLIDQQSNKLAKEEMLQMIRHGATHVFASKESELTDEDITTILERGEKKTAEMNERLQKMGESSLRNFRMDIEQSLYKFEGEDYREKQKLGMVEWIEPPKRERKANYAVDAYFREALRVSEPKIPKAPRPPKQPNVQDFQFFPPRLFELLEKEILYYRKTIGYKVPRNPDIPNPALAQREEQKKIDGAEPLTPEETEEKEKLLTQGFTNWTKRDFNQFIKANEKYGRDDIDNIAREVEGKSPEEVMEYSAVFWERCNELQDIEKIMAQIERGEARIQRRISIKKALDAKIARYKAPFHQLRIQYGTSKGKNYTEEEDRFLICMLHKMGFDRENVYEELRQCVRNAPQFRFDWFIKSRTAMEFQRRCNTLISLIEKENMEIEERERAEKKKRATKTPMVKFSAFS

SEQ ID NO: 15632 - protein, 1590 aa, Homo Sapiens; identical to SEQ ID NO: 12546

SEQ ID NO: 15633 - protein, 1647 aa, Homo Sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGMGGPNMPPPGPSGVPPGMPGQPPGGPPKPWPEGPMANAAAPTSTPQKLIPPQPTGRPSPAPPAVPPAASPVMPPQTQSPGQPAQPAPMVPLHQKQSRITPIQKPRGLDPVEILQEREYRLQARIAHRIQELENLPGSLAGDLRTKATIELKALRLLNFQRQLRQEVVVCMRRDTALETALNAKAYKRSKRQSLREARITEKLEKQQKIEQERKRRQKHQEYLNSILQHAKDFKEYHRSVTGKIQKLTKAVATYHANTEREQKKENERIEKERMRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEEEEEEQPQAAQPPTLPVEEKKKIPDPDSDDVSEVDARHIIENAKQDVDDEYGVSQALARGLQSYYAVAHAVTERVDKQSALMVNGVLKQYQIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIRWKYMIVDEGHRMKNHHCKLTQVLNTHYVAPRRLLLTGTPLQNKLPELWALLNFLLPTIFKSCSTFEQWFNAPFAMTGEKVDLNEEETILIIRRLHKVLRPFLLRRLKKEVEAQLPEKVEYVIKCDMSALQRVLYRHMQAKGVLLTDGSEKDKKGKGGTKTLMNTIMQLRKICNHPYMFQHIEESFSEHLGFTGGIVQGLDLYRASGKFELLDRILPKLRATNHKVLLFCQMTSLMTIMEDYFAYRGFKYLRLDGTTKAEDRGMLLKTFNEPGSEYFIFLLSTRAGGLGLNLQSADTVIIFDSDWNPHQDLQAQDRAHRIGQQNEVRVLRLCTVNSVEEKILAAAKYKLNVDQKVIQAGMFDQKSSSHERRAFLQAILEHEEQDESRHCSTGSGSASFAHTAPPPAGVNPDLEEPPLKEEDEVPDDETVNQMIARHEEEFDLFMRMDLDRRREEARNPKRKPRLMEEDELPSWIIKDDAEVERLTCEEEEEKMFGRGSRHRKEVDYSDSLTEKQWLKAIEEGTLEEIEEEVRQKKSSRKRKRDSDAGSSTPTTSTRSRDKDDESKKQKKRGRPPAEKLSPNPPNLTKKMKKIVDAVIKYKDSSSGRQLSEVFIQLPSRKELPEYYELIRKPVDFKKIKERIRNHKYRSLNDLEKDVMLLCQNAQTFNLEGSLIYEDSIVLQSVFTSVRQKIEKEDDSEGEESEEEEEGEEEGSESESRSVKVKIKLGRKEKAQDRLKGGRRRPSRGSRAKPVVSDDDSEEEQEEDRSGSGSEED

SEQ ID NO: 15634 - protein, 1052 aa, Homo Sapiens
MSSAAEPPPPPPPESAPSKPAASIASGGSNSSNKGGPEGVAAQAVASAASAGPADAEMEEIFDDASPGKQKEIQEPDPTYEEKMQTDRANRFEYLLKQTELFAHFIQPAAQKTPTSPLKMKPGRPRIKKDEKQNLLSVGDYRHRRTEQEEDEELLTESSKATNVCTRFEDSPSYVKWGKLRDYQVRGLNWLISLYENGINGILADEMGLGKTLQTISLLGYMKHYRNIPGPHMVLVPKSTLHNWMSEFKRWVPTLRSVCLIGDKEQRAAFVRDVLLPGEWDVCVTSYEMLIKEKSVFKKFNWRYLVIDEAHRIKNEKSKLSEIVREFKTTNRLLLTGTPLQNNLHELWSLLNFLLPDVFNSADDFDSWFDTNNCLGDQKLVERLHMVLRPFLLRRIKADVEKSLPPKKEVKIYVGLSKMQREWYTRILMKDIDILNSAGKMDKMRLLNILMQLRKCCNHPYLFDGAEPGPPYTTDMHLVTNSGKMVVLDKLLPKLKEQGSRVLIFSQMTRVLDILEDYCMWRNYEYCRLDGQTPHDERQDSINAYNEPNSTKFVFMLSTRAGGLGINLATADVVILYDSDWNPQVDLQAMDRAHRIGQTKTVRVFRFITDNTVEERIVERAEMKLRLDSIVIQQGRLVDQNLNKIGKDEMLQMIRHGATHVFASKESEITDEDIDGILERGAKKTAEMNEKLSKMGESSLRNFTMDTESSVYNFEGEDYREKQKIAFTEWIEPPKRERKANYAVDAYFREALRVSEPKAPKAPRPPKQPNVQDFQFFPPRLFELLEKEILFYRKTIGYKVPRNPELPNAAQAQKEEQLKIDEAESLNDEELEEKEKLLTQGFTNWNKRDFNQFIKANEKWGRDDIENIAREVEGKTPEEVIEYSAVFWERCNELQDIEKIMAQIERGEARIQRRISIKKALDTKIGRYKAPFHQLRISYGTNKGKNYTEEEDRFLICMLHKLGFDKENVYDELRQCIRNSPQFRFDWFLKSRTAMELQRRCNTLITLIERENMELEEKEKAEKKKRGPKPSTQKRKMDGAPDGRGRKKKLKL

SEQ ID NO: 15635 - protein, 1026 aa, Homo Sapiens
MNLFNLDRFRFEKRNKIEEAPEATPQPSQPGPSSPISLSAEEENAEGEVSRANTPDSDITEKTEDSSVPETPDNERKASISYFKNQRGIQYIDLSSDSEDVVSPNCSNTVQEKTFNKDTVIIVSEPSEDEESQGLPTMARRNDDISELEDLSELEDLKDAKLQTLKELFPQRSDNDLLKLIESTSTMDGAIAAALLMFGDAGGGPRKRKLSSSSEPYEEDEFNDDQSIKKTRLDHGEESNESAESSSNWEKQESIVLKLQKEFPNFDKQELREVLKEHEWMYTEALESLKVFAEDQDMQYVSQSEVPNGKEVSSRSQNYPKNATKTKLKQKFSMKAQNGFNKKRKKNVFNPKRVVEDSEYDSGSDVGSSLDEDYSSGEEVMEDGYKGKILHFLQDASIGELTLIPQCSQKKAQKITELRPFNSWEALFTKMSKTNGLSEDLIWHCKTLIQERDVVIRLMNKCEDISNKLTKQVTMLTGNGGGWNIEQPSILNQSLSLKPYQKVGLNWLALVHKHGLNGILADEMGLGKTIQAIAFLAYLYQEGNNGPHLIVVPASTIDNWLREVNLWCPTLKVLCYYGSQEERKQIRFNIHSRYEDYNVIVTTYNCAISSSDDRSLFRRLKLNYAIFDEGHMLKNMGSIRYQHLMTINANNRLLLTGTPVQNNLLELMSLLNFVMPHMFSSSTSEIRRMFSSKTKSADEQSIYEKERIAHAKQIIKPFILRRVKEEVLKQLPPKKDRIELCAMSEKQEQLYLGLFNRLKKSINNLEKNTEMCNVMMQLRKMANHPLLHRQYYTAEKLKEMSQLMLKEPTHCEANPDLIFEDMEVMTDFELHVLCKQYRHINNFQLDMDLILDSGKFRVLGCILSELKQKGDRVVLFSQFTMMLDILEVLLKHHQHRYLRLDGKTQISERIHLIDEFNTDMDIFVFLLSTKAGGLGINLTSANVVILHDIDCNPYNDKQAEDRCHRVGQTKEVLVIKLISQGTIEESMLKINQQKLKLEQDMTTVDEGDEGSMPADIATLLKTSMGL

SEQ ID NO: 15636 - protein, 954 aa, Homo Sapiens
MSLPLTEEQRKKIEENRQKALARRAEKLLAEQHQRTSSGTSIAGNPFQAKQGPSQNFPRESCKPVSHGVIFKQQNLSSSSNADQRPHDSHSFQAKGIWKKPEEMPTACPGHSPRSQMALTGISPPLAQSPPEVPKQQLLSYELGQGHAQASPEIRFTPFANPTHKPLAKPKSSQETPAHSSGQPPRDAKLEAKTAKASPSGQNISYIHSSSESVTPRTEGRLQQKSGSSVQKGVNSQKGKCVRNGDRFQVLIGYNAELIAVFKTLPSKNYDPDTKTWNFSMNDYSALMKAAQSLPTVNLQPLEWAYGSSESPSTSSEGQAGLPSAPSLSFVKGRCMLISRAYFEADISYSQDLIALFKQMDSRRYDVKTRKWSFLLEEHSKLIAKVRCLPQVQLDPLPTTLTLAFASQLKKTSLSLTPDVPEADLSEVDPKLVSNLMPFQRAGVNFAIAKGGRLLLADDMGLGKTIQAICIAAFYRKEWPLLVVVPSSVRFTWEQAFLRWLPSLSPDCINVVVTGKDRLTAGLINIVSFDLLSKLEKQLKTPFKVVIIDESHFLKNSRTARCRAAMPVLKVAKRVILLSGTPAMSRPAELYTQIIAVKPTFFPQFHAFGLRYCDAKRMPWGWDYSGSSNLGELKLLLEEAVMLRRLKSDVLSQLPAKQRKIVVIAPGRINARTRAALDAAAKEMTTKDKTKQQQKDALILFFNRTAEAKIPSVIEYILDLLESGREKFLVFAHHKVVLDAITQELERKHVQHIRIDGSTSSAEREDLCQQFQLSERHAVAVLSITAANMGLTFSSADLVVFAELFWNPGVLIQAEDRVHRIGQTSSVGIHYLVAKGTADDYLWPLIQEKIKVLAEAGLSETNFSEMTESTDYLYKDPKQQKIYDLFQKSFEKEGSDMELLEAAESFDPGSASGTSGSSSQNMGDTLDESSLTASPQKKRRFEFFDNWDSFTSPL

SEQ ID NO: 15637 - protein, 385 aa, Homo Sapiens
MMMMALSKTFGQKPVKFQLEDDGEFYMIGSEVGNYLRMFRGSLYKRYPSLWRRLATVEERKKIVASSHGKKTKPNTKDHGYTTLATSVTLLKASEVEEILDGNDEKYKAVSISTEPPTYLREQKAKRNSQWVPTLPNSSHHLDAVPCSTTINRNRMGRDKKRTFPLCFDDHDPAVIHENASQPEVLVPIRLDMEIDGQKLRDAFTWNMNEKLMTPEMFSEILCDDLDLNPLTFVPAIASAIRQQIESYPTDSILEDQSDQRVIIKLNIHVGNISLVDQFEWDMSEKENSPEKFALKLCSELGLGGEFVTTIAYSIRGQLSWHQKTYAFSENPLPTVEIAIRNTGDADQWCPLLETLTDAEMEKKIRDQDRNTRRMRRLANTAPAW

SEQ ID NO: 15638 - protein, 1105 aa, Homo Sapiens
MAAAAGGGGPGTAVGATGSGIAAAAAGLAVYRRKDGGPATKFWESPETVSQLDSVRVWLGKHYKKYVHADAPTNKTLAGLVVQLLQFQEDAFGKHVTNPAFTKLPAKCFMDFKAGGALCHILGAAYKYKNEQGWRRFDLQNPSRMDRNVEMFMNIEKTLVQNNCLTRPNIYLIPDIDLKLANKLKDIIKRHQGTFTDEKSKASHHIYPYSSSQDDEEWLRPVMRKEKQVLVHWGFYPDSYDTWVHSNDVDAEIEDPPIPEKPWKVHVKWILDTDIFNEWMNEEDYEVDENRKPVSFRQRISTKNEEPVRSPERRDRKASANARKRKHSPSPPPPTPTESRKKSGKKGQASLYGKRRSQKEEDEQEDLTKDMEDPTPVPNIEEVVLPKNVNLKKDSENTPVKGGTVADLDEQDEETVTAGGKEDEDPAKGDQSRSVDLGEDNVTEQTNHIIIPSYASWFDYNCIHVIERRALPEFFNGKNKSKTPEIYLAYRNFMIDTYRLNPQEYLTSTACRRNLTGDVCAVMRVHAFLEQWGLVNYQVDPESRPMAMGPPPTPHFNVLADTPSGLVPLHLRSPQVPAAQQMLNFPEKNKEKPVDLQNFGLRTDIYSKKTLAKSKGASAGREWTEQETLLLLEALEMYKDDWNKVSEHVGSRTQDECILHFLRLPIEDPYLENSDASLGPLAYQPVPFSQSGNPVMSTVAFLASVVDPRVASAAAKAALEEFSRVREEVPLELVEAHVKKVQEAARASGKVDPTYGLESSCIAGTGPDEPEKLEGAEEEKMEADPDGQQPEKAENKVENETDEGDKAQDGENEKNSEKEQDSEVSEDTKSEEKETEENKELTDTCKERESDTGKKKVEHEISEGNVATAAAAALASAATKAKHLAAVEERKIKSLVALLVETQMKKLEIKLRHFEELETIMDREKEALEQQRQQLLTERQNFHMEQLKYAELRARQQMEQQQHGQNPQQAHQHSGGPGLAPLGAAGHPGMMPHQQPPPYPLMHHQMPPPHPPQPGQIPGPGSMMPGQHMPGRMIPTVAANIHPSGSGPTPPGMPPMPGNILGPRVPLTAPNGMYPPPPQQQPPPPPPADGVPPPPAPGPPASAAP

SEQ ID NO: 15639 - protein, 1214 aa, Homo Sapiens
MAVRKKDGGPNVKYYEAADTVTQFDNVRLWLGKNYKKYIQAEPPTNKSLSSLVVQLLQFQEEVFGKHVSNAPLTKLPIKCFLDFKAGGSLCHILAAAYKFKSDQGWRRYDFQNPSRMDRNVEMFMTIEKSLVQNNCLSRPNIFLCPEIEPKLLGKLKDIIKRHQGTVTEDKNNASHVVYPVPGNLEEEEWVRPVMKRDKQVLLHWGYYPDSYDTWIPASEIEASVEDAPTPEKPRKVHAKWILDTDTFNEWMNEEDYEVNDDKNPVSRRKKISAKTLTDEVNSPDSDRRDKKGGNYKKRKRSPSPSPTPEAKKKNAKKGPSTPYTKSKRGHREEEQEDLTKDMDEPSPVPNVEEVTLPKTVNTKKDSESAPVKGGTMTDLDEQEDESMETTGKDEDENSTGNKGEQTKNPDLHEDNVTEQTHHIIIPSYAAWFDYNSVHAIERRALPEFFNGKNKSKTPEIYLAYRNFMIDTYRLNPQEYLTSTACRRNLAGDVCAIMRVHAFLEQWGLINYQVDAESRPTPMGPPPTSHFHVLADTPSGLVPLQPKTPQQTSASQQMLNFPDKGKEKPTDMQNFGLRTDMYTKKNVPSKSKAAASATREWTEQETLLLLEALEMYKDDWNKVSEHVGSRTQDECILHFLRLPIEDPYLEDSEASLGPLAYQPIPFSQSGNPVMSTVAFLASVVDPRVASAAAKSALEEFSKMKEEVPTALVEAHVRKVEEAAKVTGKADPAFGLESSGIAGTTSDEPERIEESGNDEARVEGQATDEKKEPKEPREGGGAIEEEAKEKTSEAPKKDEEKGKEGDSEKESEKSDGDPIVDPEKEKEPKEGQEEVLKEVVESEGERKTKVERDIGEGNLSTAAAAALAAAAVKAKHLAAVEERKIKSLVALLVETQMKKLEIKLRHFEELETIMDREREALEYQRQQLLADRQAFHMEQLKYAEMRARQQHFQQMHQQQQQPPPALPPGSQPIPPTGAAGPPAVHGLAVAPASVVPAPAGSGAPPGSLGPSEQIGQAGSTAGPQQQQPAGAPQPGAVPPGVPPPGPHGPSPFPNQQTPPSMMPGAVPGSGHPGVAGNAPLGLPFGMPPPPPPPAPSIIPFGSLADSISINLPAPPNLHGHHHHLPFAPGTLPPPNLPVSMANPLHPNLPATTTMPSSLPLGPGLGSAAAQSPAIVAAVQGNLLPSASPLPDPGTPLPPDPTAPSPGTVTPVPPPQ

SEQ ID NO: 15640 - protein, 515 aa, Homo Sapiens
MAARAGFQSVAPSGGAGASGGAGAAAALGPGGTPGPPVRMGPAPGQGLYRSPMPGAAYPRPGMLPGSRMTPQGPSMGPPGYGGNPSVRPGLAQSGMDQSRKRPAPQQIQQVQQQAVQNRNHNAKKKKMADKILPQRIRELVPESQAYMDLLAFERKLDQTIMRKRLDIQEALKRPIKQKRKLRIFISNTFNPAKSDAEDGEGTVASWELRVEGRLLEDSALSKYDATKQKRKFSSFFKSLVIELDKDLYGPDNHLVEWHRTATTQETDGFQVKRPGDVNVRCTVLLMLDYQPPQFKLDPRLARLLGIHTQTRPVIIQALWQYIKTHKLQDPHEREFVICDKYLQQIFESQRMKFSEIPQRLHALLMPPEPIIINHVISVDPNDQKKTACYDIDVEVDDTLKTQMNSFLLSTASQQEIATLDNKIHETIETINQLKTQREFMLSFARDPQGFINDWLQSQCRDLKTMTDVVGNPEEERRAEFYFQPWAQEAVCRYFYSKVQQRRQELEQALGIRNT

SEQ ID NO: 15641 - protein, 531 aa, Homo Sapiens
MSGRGAGGFPLPPLSPGGGAVAAALGAPPPPAGPGMLPGPALRGPGPAGGVGGPGAAAFRPMGPAGPAAQYQRPGMSPGNRMPMAGLQVGPPAGSPFGAAAPLRPGMPPTMMDPFRKRLLVPQAQPPMPAQRRGLKRRKMADKVLPQRIRELVPESQAYMDLLAFERKLDQTIARKRMEIQEAIKKPLTQKRKLRIYISNTFSPSKAEGDSAGTAGTPGGTPAGDKVASWELRVEGKLLDDPSKQKRKFSSFFKSLVIELDKELYGPDNHLVEWHRMPTTQETDGFQVKRPGDLNVKCTLLLMLDHQPPQYKLDPRLARLLGVHTQTRAAIMQALWLYIKHNQLQDGHEREYINCNRYFRQIFSCGRLRFSEIPMKLAGLLQHPDPIVINHVISVDPNDQKKTACYDIDVEVDDPLKAQMSNFLASTTNQQEIASLDVKIHETIESINQLKTQRDFMLSFSTDPQDFIQEWLRSQRRDLKIITDVIGNPEEERRAAFYHQPWAQEAVGRHIFAKVQQRRQELEQVLGIRLT

SEQ ID NO: 15642 - protein, 483 aa, Homo Sapiens
MAADEVAGGARKATKSKLFEFLVHGVRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 15643 - protein, 411 aa, Homo Sapiens
MSKRPSYAPPPTPAPATQMPSTPGFVGYNPYSHLAYNNYRLGGNPGTNSRVTASSGITIPKPPKPPDKPLMPYMRYSRKVWDQVKASNPDLKLWEIGKIIGGMWRDLTDEEKQEYLNEYEAEKIEYNESMKAYHNSPAYLAYINAKSRAEAALEEESRQRQSRMEKGEPYMSIQPAEDPDDYDDGFSMKHTATARFQRNHRLISEILSESVVPDVRSVVTTARMQVLKRQVQSLMVHQRKLEAELLQIEERHQEKKRKFLESTDSFNNELKRLCGLKVEVDMEKIAAEIAQAEEQARKRQEEREKEAAEQAERSQSSIVPEEEQAANKGEEKKDDENIPMETEETHLEETTESQQNGEEGTSTPEDKESGQEGVDSMAEEGTSDSNTGSESNSATVEEPPTDPIPEDEKKE

SEQ ID NO: 15644 - protein, 264 aa, Homo Sapiens
MPRSFLVRKPSDPNRKPNYSELQDSNPEFTFQQPYDQAHLLAAIPPPEILNPTASLPMLIWDSVLAPQAQPIAWASLRLQESPRVAELTSLSDEDSGKGSQPPSPPSPAPSSFSSTSVSSLEAEAYAAFPGLGQVPKQLAQLSEAKDLQARKAFNCKYCNKEYLSLGALKMHIRSHTLPCVCGTCGKAFSRPWLLQGHVRTHTGEKPFSCPHCSRAFADRSNLRAHLQTHSDVKKYQCQACARTFSRMSLLHKHQESGCSGCPR

SEQ ID NO: 15645 - protein, 268 aa, Homo Sapiens
MPRSFLVKKHFNASKKPNYSELDTHTVIISPYLYESYSMPVIPQPEILSSGAYSPITVWTTAAPFHAQLPNGLSPLSGYSSSLGRVSPPPPSDTSSKDHSGSESPISDEEERLQSKLSDPHAIEAEKFQCNLCNKTYSTFSGLAKHKQLHCDAQSRKSFSCKYCDKEYVSLGALKMHIRTHTLPCVCKICGKAFSRPWLLQGHIRTHTGEKPFSCPHCNRAFADRSNLRAHLQTHSDVKKYQCKNCSKTFSRMSLLHKHEESGCCVAH

SEQ ID NO: 15646 - protein, 292 aa, Homo Sapiens
MPRSFLVKTHSSHRVPNYRRLETQREINGACSACGGLVVPLLPRDKEAPSVPGDLPQPWDRSSAVACISLPLLPRIEEALGASGLDALEVSEVDPRASRAAIVPLKDSLNHLNLPPLLVLPTRWSPTLGPDRHGAPEKLLGAERMPRAPGGFECFHCHKPYHTLAGLARHRQLHCHLQVGRVFTCKYCDKEYTSLGALKMHIRTHTLPCTCKICGKAFSRPWLLQGHVRTHTGEKPYACSHCSRAFADRSNLRAHLQTHSDAKKYRCRRCTKTFSRMSLLARHEESGCCPGP

SEQ ID NO: 15647 - protein, 1469 aa, Homo Sapiens
MDVDAEREKITQEIKELERILDPGSSGSHVEISESSLESDSEADSLPSEDLDPADPPISEEERWGEASNDEDDPKDKTLPEDPETCLQLNMVYQEVIQEKLAEANLLLAQNREQQEELMRDLAGSKGTKVKDGKSLPPSTYMGHFMKPYFKDKVTGVGPPANEDTREKAAQGIKAFEELLVTKWKNWEKALLRKSVVSDRLQRLLQPKLLKLEYLHQKQSKVSSELERQALEKQGREAEKEIQDINQLPEEALLGNRLDSHDWEKISNINFEGSRSAEEIRKFWQNSEHPSINKQEWSREEEERLQAIAAAHGHLEWQKIAEELGTSRSAFQCLQKFQQHNKALKRKEWTEEEDRMLTQLVQEMRVGSHIPYRRIVYYMEGRDSMQLIYRWTKSLDPGLKKGYWAPEEDAKLLQAVAKYGEQDWFKIREEVPGRSDAQCRDRYLRRLHFSLKKGRWNLKEEEQLIELIEKYGVGHWAKIASELPHRSGSQCLSKWKIMMGKKQGLRRRRRRARHSVRWSSTSSSGSSSGSSGGSSSSSSSSSEEDEPEQAQAGEGDRALLSPQYMVPDMDLWVPARQSTSQPWRGGAGAWLGGPAASLSPPKGSSASQGGSKEASTTAAAPGEETSPVQVPARAHGPVPRSAQASHSADTRPAGAEKQALEGGRRLLTVPVETVLRVLRANTAARSCTQKEQLRQPPLPTSSPGVSSGDSVARSHVQWLRHRATQSGQRRWRHALHRRLLNRRLLLAVTPWVGDVVVPCTQASQRPAVVQTQADGLREQLQQARLASTPVFTLFTQLFHIDTAGCLEVVRERKALPPRLPQAGARDPPVHLLQASSSAQSTPGHLFPNVPAQEASKSASHKGSRRLASSRVERTLPQASLLASTGPRPKPKTVSELLQEKRLQEARAREATRGPVVLPSQLLVSSSVILQPPLPHTPHGRPAPGPTVLNVPLSGPGAPAAAKPGTSGSWQEAGTSAKDKRLSTMQALPLAPVFSEAEGTAPAASQAPALGPGQISVSCPESGLGQSQAPAASRKQGLPEAPPFLPAAPSPTPLPVQPLSLTHIGGPHVATSVPLPVTWVLTAQGLLPVPVPAVVSLPRPAGTPGPAGLLATLLPPLTETRAAQGPRAPALSSSWQPPANMNREPEPSCRTDTPAPPTHALSQSPAEADGSVAFVPGEAQVAREIPEPRTSSHADPPEAEPPWSGRLPAFGGVIPATEPRGTPGSPSGTQEPRGPLGLEKLPLRQPGPEKGALDLEKPPLPQPGPEKGALDLGLLSQEGEAATQQWLGGQRGVRVPLLGSRLPYQPPALCSLRALSGLLLHKKALEHKATSLVVGGEAERPAGALQASLGLVRGQLQDNPAYLLLRARFLAAFTLPALLATLAPQGVRTTLSVPSRVGSESEDEDLLSELELADRDGQPGCTTATCPIQGAPDSGKCSASSCLDTSNDPDDLDVLRTRHARHTRKRRRLV

SEQ ID NO: 15648 - protein, 328 aa, Homo Sapiens
MASRCSEPYPEVSRIPTVRGCNGSLSGALSCCEDSARGSGPPKAPTVAEGPSSCLRRNVISERERRKRMSLSCERLRALLPQFDGRREDMASVLEMSVQFLRLASALGPSQEQHAILASSKEMWHSLQEDVLQLTLSSQIQAGVPDPGTGASSGTRTPDVKAFLESPWSLDPASASPEPVPHILASSRQWDPASCTSLGTDKCEALLGLCQVRGGLPPFSEPSSLVPWPPGRSLPKAVRPPLSWPPFSQQQTLPVMSGEALGWLGQAGPLAMGAAPLGEPAKEDPMLAQEAGSALGSDVDDGTSFLLTAGPSSWPGEWGPGFRAGPPA

SEQ ID NO: 15649 - protein, 425 aa, Homo Sapiens
MASSIICQEHCQISGQAKIDILLVGDVTVGYLADTVQKLFANIAEVTITISDTKEAAALLDDCIFNMVLLKVPSSLSAEELEAIKLIRFGKKKNTHSLFVFIIPENFKGCISGHGMDIALTEPLTMEKMSNVVKYWTTCPSNTVKTENATGPEELGLPLQRSYSEHLGYFPTDLFACSESLRNGNGLELNASLSEFEKNKKISLLHSSKEKLRRERIKYCCEQLRTLLPYVKGRKNDAASVLEATVDYVKYIREKISPAVMAQITEALQSNMRFCKKQQTPIELSLPGTVMAQRENSVMSTYSPERGLQFLTNTCWNGCSTPDAESSLDEAVRVPSSSASENAIGDPYKTHISSAALSLNSLHTVRYYSKVTPSYDATAVTNQNISIHLPSAMPPVSKLLPRHCTSGLGQTCTTHPNCLQQFWAY

SEQ ID NO: 15650 - protein, 391 aa, Homo Sapiens
MYSMMMETDLHSPGGAQAPTNLSGPAGAGGGGGGGGGGGGGGGAKANQDRVKRPMNAFMVWSRGQRRKMAQENPKMHNSEISKRLGAEWKVMSEAEKRPFIDEAKRLRALHMKEHPDYKYRPRRKTKTLLKKDKYSLAGGLLAAGAGGGGAAVAMGVGVGVGAAAVGQRLESPGGAAGGGYAHVNGWANGAYPGSVAAAAAAAAMMQEAQLAYGQHPGAGGAHPHAHPAHPHPHHPHAHPHNPQPMHRYDMGALQYSPISNSQGYMSASPSGYGGLPYGAAAAAAAAAGGAHQNSAVAAAAAAAAASSGALGALGSLVKSEPSGSPPAPAHSRAPCPGDLREMISMYLPAGEGGDPAAAAAAAAQSRLHSLPQHYQGAGAGVNGTVPLTHI

SEQ ID NO: 15651 - protein, 466 aa, Homo Sapiens
MAEEQDLSEVELSPVGSEEPRCLSPGSAPSLGPDGGGGGSGLRASPGPGELGKVKKEQQDGEADDDKFPVCIREAVSQVLSGYDWTLVPMPVRVNGASKSKPHVKRPMNAFMVWAQAARRKLADQYPHLHNAELSKTLGKLWRLLNESDKRPFIEEAERLRMQHKKDHPDYKYQPRRRKNGKAAQGEAECPGGEAEQGGTAAIQAHYKSAHLDHRHPGEGSPMSDGNPEHPSGQSHGPPTPPTTPKTELQSGKADPKRDGRSMGEGGKPHIDFGNVDIGEISHEVMSNMETFDVAELDQYLPPNGHPGHVSSYSAAGYGLGSALAVASGHSAWISKPPGVALPTVSPPGVDAKAQVKTETAGPQGPPHYTDQPSTSQIAYTSLSLPHYGSAFPSISRPQFDYSDHQPSGPYYGHSGQASGLYSAFSYMGPSQRPLYTAISDPSPSGPQSHSPTHWEQPVYTTLSRP

SEQ ID NO: 15652 - protein, 441 aa, Homo Sapiens
MVQQAESLEAESNLPREALDTEEGEFMACSPVALDESDPDWCKTASGHIKRPMNAFMVWSKIERRKIMEQSPDMHNAEISKRLGKRWKMLKDSEKIPFIREAERLRLKHMADYPDYKYRPRKKPKMDPSAKPSASQSPEKSAAGGGGGSAGGGAGGAKTSKGSSKKCGKLKAPAAAGAKAGAGKAAQSGDYGGAGDDYVLGSLRVSGSGGGGAGKTVKCVFLDEDDDDDDDDDELQLQIKQEPDEEDEEPPHQQLLQPPGQQPSQLLRRYNVAKVPASPTLSSSAESPEGASLYDEVRAGATSGAGGGSRLYYSFKNITKQHPPPLAQPALSPASSRSVSTSSSSSSGSSSGSSGEDADDLMFDLSLNFSQSAHSASEQQLGGGAAAGNLSLSLVDKDLDSFSEGSLGSHFEFPDYCTPELSEMIAGDWLEANFSDLVFTY

SEQ ID NO: 15653 - protein, 315 aa, Homo Sapiens
MVQQRGARAKRDGGPPPPGPGPAEEGAREPGWCKTPSGHIKRPMNAFMVWSQHERRKIMDQWPDMHNAEISKRLGRRWQLLQDSEKIPFVREAERLRLKHMADYPDYKYRPRKKSKGAPAKARPRPPGGSGGGSRLKPGPQLPGRGGRRAAGGPLGGGAAAPEDDDEDDDEELLEVRLVETPGRELWRMVPAGRAARGQAERAQGPSGEGAAAAAAASPTPSEDEEPEEEEEEAAAAEEGEEETVASGEESLGFLSRLPPGPAGLDCSALDRDPDLQPPSGTSHFEFPDYCTPEVTEMIAGDWRPSSIADLVFTY

SEQ ID NO: 15654 - protein, 622 aa, Homo Sapiens
MSMRSPISAQLALDGVGTMVNCTIKSEEKKEPCHEAPQGSATAAEPQPGDPARASQDSADPQAPAQGNFRGSWDCSSPEGNGSPEPKRPGVSEAASGSQEKLDFNRNLKEVVPAIEKLLSSDWKERFLGRNSMEAKDVKGTQESLAEKELQLLVMIHQLSTLRDQLLTAHSEQKNMAAMLFEKQQQQMELARQQQEQIAKQQQQLIQQQHKINLLQQQIQQVNMPYVMIPAFPPSHQPLPVTPDSQLALPIQPIPCKPVEYPLQLLHSPPAPVVKRPGAMATHHPLQEPSQPLNLTAKPKAPELPNTSSSPSLKMSSCVPRPPSHGGPTRDLQSSPPSLPLGFLGEGDAVTKAIQDARQLLHSHSGALDGSPNTPFRKDLISLDSSPAKERLEDGCVHPLEEAMLSCDMDGSRHFPESRNSSHIKRPMNAFMVWAKDERRKILQAFPDMHNSSISKILGSRWKSMTNQEKQPYYEEQARLSRQHLEKYPDYKYKPRPKRTCIVEGKRLRVGEYKALMRTRRQDARQSYVIPPQAGQVQMSSSDVLYPRAAGMPLAQPLVEHYVPRSLDPNMPVIVNTCSLREEGEGTDDRHSVADGEMYRYSEDEDSEGEEKSDGELVVLTD

SEQ ID NO: 15655 - protein, 240 aa, Homo Sapiens
MSKPSDHIKRPMNAFMVWSRGQRRKMAQENPKMHNSEISKRLGAEWKLLSEAEKRPYIDEAKRLRAQHMKEHPDYKYRPRRKPKNLLKKDRYVFPLPYLGDTDPLKAAGLPVGASDGLLSAPEKARAFLPPASAPYSLLDPAQFSSSAIQKMGEVPHTLATGALPYASTLGYQNGAFGSLSCPSQHTHTHPSPTNPGYVVPCNCTAWSASTLQPPVAYILFPGMTKTGIDPYSSAHATAM

SEQ ID NO: 15656 - protein, 233 aa, Homo Sapiens [sequence omitted]

SEQ ID NO: 15657 - protein, 414 aa, Homo Sapiens [sequence omitted]

SEQ ID NO: 15658 - protein, 384 aa, Homo Sapiens [sequence omitted]

SEQ ID NO: 15659 - protein, 317 aa, Homo Sapiens
MYNMMETELKPPGPQQTSGGGGGNSTAAAAGGNQKNSPDRVKRPMNAFMVWSRGQRRKMAQENPKMHNSEISKRLGAEWKLLSETEKRPFIDEAKRLRALHMKEHPDYKYRPRRKTKTLMKKDKYTLPGGLLAPGGNSMASGVGVGAGLGAGVNQRMDSYAHMNGWSNGSYSMMQDQLGYPQHPGLNAHGAAQMQPMHRYDVSALQYNSMTSSQTYMNGSPTYSMSYSQQGTPGMALGSMGSVVKSEASSSPPVVTSSSHSRAPCQAGDLRDMISMYLPGAEVPEPAAPSRLHMSQHYQSGPVPGTAINGTLPLSHM

SEQ ID NO: 15660 - protein, 276 aa, Homo Sapiens
MSKPVDHVKRPMNAFMVWSRAQRRKMAQENPKMHNSEISKRLGAEWKLLTESEKRPFIDEAKRLRAMHMKEHPDYKYRPRRKPKTLLKKDKFAFPVPYGLGGVADAEHPALKAGAGLHAGAGGGLVPESLLANPEKAAAAAAAAAARVFFPQSAAAAAAAAAAAAAGSPYSLLDLGSKMAEISSSSSGLPYASSLGYPTAGAGAFHGAAAAAAAAAAAAGGHTHSHPSPGNPGYMIPCNCSAWPSPGLQPPLAYILLPGMGKPQLDPYPAAYAAAL

SEQ ID NO: 15661 - protein, 446 aa, Homo Sapiens
MRPVRENSSGARSPRVPADLARSILISLPFPPDSLAHRPPSSAPTESQGLFTVAAPAPGAPSPPATLAHLLPAPAMYSLLETELKNPVGTPTQAAGTGGPAAPGGAGKSSANAAGGANSGGGSSGGASGGGGGTDQDRVKRPMNAFMVWSRGQRRKMALENPKMHNSEISKRLGADWKLLTDAEKRPFIDEAKRLRAVHMKEYPDYKYRPRRKTKTLLKKDKYSLPSGLLPPGAAAAAAAAAAAAAAASSPVGVGQRLDTYTHVNGWANGAYSLVQEQLGYAQPPSMSSPPPPPALPPMHRYDMAGLQYSPMMPPGAQSYMNVAAAAAAASGYGGMAPSATAAAAAAYGQQPATAAAAAAAAAAMSLGPMGSVVKSEPSSPPPAIASHSQRACLGDLRDMISMYLPPGGDAADAASPLPGGRLHGVHQHYQGAGTAVNGTVPLTHI

SEQ ID NO: 15662 - protein, 753 aa, Homo Sapiens [sequence omitted]

SEQ ID NO: 15663 - protein, 474 aa, Homo Sapiens
MVQQTNNAENTEALLAGESSDSGAGLELGIASSPTPGSTASTGGKADDPSWCKTPSGHIKRPMNAFMVWSQIERRKIMEQSPDMHNAEISKRLGKRWKLLKDSDKIPFIREAERLRLKHMADYPDYKYRPRKKVKSGNANSSSSAAASSKPGEKGDKVGGSGGGGHGGGGGGGSSNAGGGGGGASGGGANSKPAQKKSCGSKVAGGAGGGVSKPHAKLILAGGGGGGKAAAAAAASFAAEQAGAAALLPLGAAADHHSLYKARTPSASASASSAASASAALAAPGKHLAEKKVKRVYLFGGLGTSSSPVGGVGAGADPSDPLGLYEEEGAGCSPDAPSLSGRSSAASSPAAGRSPADHRGYASLRAASPAPSSAPSHASSSASSHSSSSSSSGSSSSDDEFEDDLLDLNPSSNFESMSLGSFSSSSALDRDLDFNFEPGSGSHFEFPDYCTPEVSEMISGDWLESSISNLVFTY

SEQ ID NO: 15664 - protein, 763 aa, Homo Sapiens [sequence omitted]

SEQ ID NO: 15665 - protein, 828 aa, Homo Sapiens
MSSKQATSPFACAADGEDAMTQDLTSREKEEGSDQHVASHLPLHPIMHNKPHSEELPTLVSTIQQDADWDSVLSSQQRMESENNKLCSLYSFRNTSTSPHKPDEGSRDREIMTSVTFGTPERRKGSLADVVDTLKQKKLEEMTRTEQEDSSCMEKLLSKDWKEKMERLNTSELLGEIKGTPESLAEKERQLSTMITQLISLREQLLAAHDEQKKLAASQIEKQRQQMDLARQQQEQIARQQQQLLQQQHKINLLQQQIQVQGHMPPLMIPIFPHDQRTLAAAAAAQQGFLFPPGITYKPGDNYPVQFIPSTMAAAAASGLSPLQLQKGHVSHPQINQRLKGLSDRFGRNLDTFEHGGGHSYNHKQIEQLYAAQLASMQVSPGAKMPSTPQPPNTAGTVSPTGIKNEKRGTSPVTQVKDEAAAQPLNLSSRPKTAEPVKSPTSPTQNLFPASKTSPVNLPNKSSIPSPIGGSLGRGSSLDILSSLNSPALFGDQDTVMKAIQEARKMREQIQREQQQQQPHGVDGKLSSINNMGLNSCRNEKERTRFENLGPQLTGKSNEDGKLGPGVIDLTRPEDAEGSKAMNGSAAKLQQYYCWPTGGATVAEARVYRDARGRASSEPHIKRPMNAFMVWAKDERRKILQAFPDMHNSNISKILGSRWKSMSNQEKQPYYEEQARLSKIHLEKYPNYKYKPRPKRTCIVDGKKLRIGEYKQLMRSRRQEMRQFFTVGQQPQIPITTGTGVVYPGAITMATTTPSPQMTSDCSSTSASPEPSLPVIQSTYGMKTDGGSLAGNEMINGEDEMEMYDDYEDDPKSDYSSENEAPEAVSAN

SEQ ID NO: 15666 - protein, 388 aa, Homo Sapiens [sequence omitted]

SEQ ID NO: 15667 - protein, 446 aa, Homo Sapiens [sequence omitted]

SEQ ID NO: 15668 - protein, 509 aa, Homo Sapiens
MNLLDPFMKMTDEQEKGLSGAPSPTMSEDSAGSPCPSGSGSDTENTRPQENTFPKGEPDLKKESEEDKFPVCIREAVSQVLKGYDWTLVPMPVRVNGSSKNKPHVKRPMNAFMVWAQAARRKLADQYPHLHNAELSKTLGKLWRLLNESEKRPFVEEAERLRVQHKKDHPDYKYQPRRRKSVKNGQAEAEEATEQTHISPNAIFKALQADSPHSSSGMSEVHSPGEHSGQSQGPPTPPTTPKTDVQPGKADLKREGRPLPEGGRQPPIDFRDVDIGELSSDVISNIETFDVNEFDQYLPPNGHPGVPATHGQVTYTGSYGISSTAATPASAGHVWMSKQQAPPPPPQQPPQAPPAPQAPPQPQAAPPQQPAAPPQQPQAHTLTTLSSEPGQSQRTHIKTEQLSPSHYSEQQQHSPQQIAYSPFNLPHYSPSYPPITRSQYDYTDHQNSSSYYSHAAGQGTGLYSTFTYMNPAQRPMYTPIADTSGVPSIPQTHSPQHWEQPVYTQLTRP

SEQ ID NO: 15669 - protein, 785 aa, Homo Sapiens
MSDQDHSMDEMTAVVKIEKGVGGNNGGNGNGGGAFSQARSSSTGSSSSTGGGGQESQPSPLALLAATCSRIESPNENSNNSQGPSQSGGTGELDLTATQLSQGANGWQIISSSSGATPTSKEQSGSSTNGSNGSESSKNRTVSGGQYVVAAAPNLQNQQVLTGLPGVMPNIQYQVIPQFQTVDGQQLQFAATGAQVQQDGSGQIQIIPGANQQIITNRGSGGNIIAAMPNLLQQAVPLQGLANNVLSGQTQYVTNVPVALNGNITLLPVNSVSAATLTPSSQAVTISSSGSQESGSQPVTSGTTISSASLVSSQASSSSFFTNANSYSTTTTTSNMGIMNFTTSGSSGTNSQGQTPQRVSGLQGSDALNIQQNQTSGGSLQAGQQKEGEQNQQTQQQQILIQPQLVQGGQALQALQAAPLSGQTFTTQAISQETLQNLQLQAVPNSGPIIIRTPTVGPNGQVSWQTLQLQNLQVQNPQAQTITLAPMQGVSLGQTSSSNTTLTPIASAASIPAGTVTVNAAQLSSMPGLQTINLSALGTSGIQVHPIQGLPLAIANAPGDHGAQLGLHGAGGDGIHDDTAGGEEGENSPDAQPQAGRRTRREACTCPYCKDSEGRGSGDPGKKKQHICHIQGCGKVYGKTSHLRAHLRWHTGERPFMCTWSYCGKRFTRSDELQRHKRTHTGEKKFACPECPKRFMRSDHLSKHIKTHQNKKGGPGVALSVGTLPLDSGAGSEGSGTATPSALITTNMVAMEAICPEGIARLANSGINVMQVADLQSINISGNGF

SEQ ID NO: 15670 - protein, 189 aa, Homo Sapiens; identical to SEQ ID NO: 3950

SEQ ID NO: 15671 - protein, 879 aa, Homo Sapiens
MAGGGGDLSTRRLNECISPVANEMNHLPAHSHDLQRMFTEDQGVDDRLLYDIVFKHFKRNKVEISNAIKKTFPFLEGLRDRDLITNKMFEDSQDSCRNLVPVQRVVYNVLSELEKTFNLPVLEALFSDVNMQEYPDLIHIYKGFENVIHDKLPLQESEEEEREERSGLQLSLEQGTGENSFRSLTWPPSGSPSHAGTTPPENGLSEHPCETEQINAKRKDTTSDKDDSLGSQQTNEQCAQKAEPTESCEQIAVQVNNGDAGREMPCPLPCDEESPEAELHNHGIQINSCSVRLVDIKKEKPFSNSKVECQAQARTHHNQASDIIVISSEDSEGSTDVDEPLEVFISAPRSEPVINNDNPLESNDEKEGQEATCSRPQIVPEPMDFRKLSTFRESFKKRVIGQDHDFSESSEEEAPAEASSGALRSKHGEKAPMTSRSTSTWRIPSRKRRFSSSDFSDLSNGEELQETCSSSLRRGSGSQPQEPENKKCSCVMCFPKGVPRSQEARTESSQASDMMDTMDVENNSTLEKHSGKRRKKRRHRSKVNGLQRGRKKDRPRKHLTLNNKVQKKRWQQRGRKANTRPLKRRRKRGPRIPKDENINFKQSELPVTCGEVKGTLYKERFKQGTSKKCIQSEDKKWFTPREFEIEGDRGASKNWKLSIRCGGYTLKVLMENKFLPEPPSTRKKRILESHNNTLVDPCEEHKKKNPDASVKFSEFLKKCSETWKTIFAKEKGKFEDMAKADKAHYEREMKTYIPPKGEKKKKFKDPNAPKRPPLAFFLFCSEYRPKIKGEHPGLSIDDVVKKLAGMWNNTAAADKQFYEKKAAKLKEKYKKDIAAYRAKGKPNSAKKRVVKAEKSKKKKEEEEDEEDEQEEENEEDDDK

SEQ ID NO: 15672 - protein, 689 aa, Homo Sapiens
MFTMTRAMEEALFQHFMHQKLGIAYAIHKPFPFFEGLLDNSIITKRMYMESLEACRNLIPVSRVVHNILTQLERTFNLSLLVTLFSQINLREYPNLVTIYRSFKRVGASYEWQSRDTPILLEAPTGLAEGSSLHTPLALPPPQPPQPSCSPCAPRVSEPGTSSQQSDEILSESPSPSDPVLPLPALIQEGRSTSVTNDKLTSKMNAEEDSEEMPSLLTSTVQVASDNLIPQIRDKEDPQEMPHSPLGSMPEIRDNSPEPNDPEEPQEVSSTPSDKKGKKRKRCIWSTPKRRHKKKSLPGGTASSRHGIQKKLKRVDQVPQKKDDSTCNSTVETRAQKARTECARKSRSEEIIDGTSEMNEGKRSQKTPSTPRRVTQGAASPGHGIQEKLQVVDKVTQRKDDSTWNSEVMMRVQKARTKCARKSRLKEKKKEKDICSSSKRRFQKNIHRRGKPKSDTVDFHCSKLPVTCGEAKGILYKKKMKHGSSVKCIRNEDGTWLTPNEFEVEGKGRNAKNWKRNIRCEGMTLGELLKRKNSDECEVCCQGGQLLCCGTCPRVFHEDCHIPPVEAKRMLWSCTFCRMKRSSGSQQCHHVSKTLERQMQPQDQLIRDYGEPFQEAMWLDLVKERLITEMYTVAWFVRDMRLMFRNHKTFYKASDFGQVGLDLEAEFEKDLKDVLGFHEANDGGFWTLP

SEQ ID NO: 15673 - protein, 867 aa, Homo Sapiens
MAQQGQQGQMASGDSNLNFRMVAEIQNVEGQNLQEQVCPEPIFRFFRENKVEIASAITRPFPFLMGLRDRSFISEQMYEHFQEAFRNLVPVTRVMYCVLSELEKTFGWSHLEALFSRINLMAYPDLNEIYRSFQNVCYEHSPLQMNNVNDLEDRPRLLPYGKQENSNACHEMDDIAVPQEALSSSPRCEPGFSSESCEQLALPKAGGGDAEDAPSLLPGGGVSCKLAIQIDEGESEEMPKLLPYDTEVLESNGMIDAARTYSTAPGEKQGEEEGRNSPRKRNQDKEKYQESPEGRDKETFDLKTPQVTNEGEPEKGLCLLPGEGEEGSDDCSEMCDGEEPQEASSSLARCGSVSCLSAETFDLKTPQVTNEGEPEKELSLLPGEGEEGSDDCSEMCDGEERQEASSSLARRGSVSSELENHPMNEEGESEELASSLLYDNVPGAEQSAYENEKCSCVMCFSEEVPGSPEARTESDQACGTMDTVDIANNSTLGKPKRKRRKKRGHGWSRMRMRRQENSQQNDNSKADGQVVSSEKKANVNLKDLSKIRGRKRGKPGTRFTQSDRAAQKRVRSRASRKHKDETVDFKAPLLPVTCGGVKGILHKKKLQQGILVKCIQTEDGKWFTPTEFEIKGGHARSKNWRLSVRCGGWPLRWLMENGFLPDPPRIRYRKKKRILKSQNNSSVDPCMRNLDECEVCRDGGELFCCDTCSRVFHEDCHIPPVEAERTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGFRLEAEFEKNFKEVFAIQETNGNN

SEQ ID NO: 15674 - protein, 580 aa, Homo Sapiens
MAGGGSDLSTRGLNGGVSQVANEMNHLPAHSQSLQRLFTEDQDVDEGLVYDTVFKHFKRHKLEISNAIKKTFPFLEGLRDRELITNKMFEDSEDSCRNLVPVQRVVYNVLSELEKTFNLSVLEALFSEVNMQEYPDLIHIYKSFKNAIQDKLSFQESDRKEREERPDIKLSLKQGEVPESPEARKESDQACGKMDTVDIANNSTLGKPKRKRRKKKGHGWSRMGTRTQKNNQQNDNSKADGQLVSSEKKANMNLKDLSKIRGRKRGKPGTHFTQSDRAPQKRVRSRASRKHKDETVDFQAPLLPVTCGGVKGILHKEKLEQGTLAKCIQTEDGKWFTPMEFEIKGGYARSKNWRLSVRCGGWPLRRLMEEGSLPNPPRIYYRNKKRILKSQNNSSVDPCMRNLDECEVCRDGGELFCCDTCSRVFHEDCHIPPVESEKTPWNCIFCRMKESPGSQQCCQESEVLERQMCPEEQLKCEFLLLKVYCCSESSFFAKIPYYYYIREACQGLKEPMWLDKIKKRLNEHGYPQVEGFVQDMRLIFQNHRASYKYKDFGQMGLRLEAEFEKDFKEVFAIQETNGNS

SEQ ID NO: 15675 - protein, 613 aa, Homo Sapiens
MSDPQTSMAATAAVSPSDYLQPAASTTQDSQPSPLALLAATCSKIGPPAVEAAVTPPAPPQPTPRKLVPIKPAPLPLSPGKNSFGILSSKGNILQIQGSQLSASYPGGQLVFAIQNPTMINKGTRSNANIQYQAVPQIQASNSQTIQVQPNLTNQIQIIPGTNQAIITPSPSSHKPVPIKPAPIQKSSTTTTPVQSGANVVKLTGGGGNVTLTLPVNNLVNASDTGAPTQLLTESPPTPLSKTNKKARKKSLPASQPPVAVAEQVETVLIETTADNIIQAGNNLLIVQSPGGGQPAVVQQVQVVPPKAEQQQVVQIPQQALRVVQAASATLPTVPQKPSQNFQIQAAEPTPTQVYIRTPSGEVQTVLVQDSPPATAAATSNTTCSSPASRAPHLSGTSKKHSAAILRKERPLPKIAPAGSIISLNAAQLAAAAQAMQTININGVQVQGVPVTITNTGGQQQLTVQNVSGNNLTISGLSPTQIQLQMEQALAGETQPGEKRRRMACTCPNCKDGEKRSGEQGKKKHVCHIPDCGKTFRKTSLLRAHVRLHTGERPFVCNWFFCGKRFTRSDELQRHARTHTGDKRFECAQCQKRFMRSDHLTKHYKTHLVTKNL

SEQ ID NO: 15676 - protein, 781 aa, Homo Sapiens
MTAPEKPVKQEEMAALDVDSGGGGGGGGGHGEYLQQQQQHGNGAVAAAAAAQDTQPSPLALLAATCSKIGPPSPGDDEEEAAAAAGAPAAAGATGDLASAQLGGAPNRWEVLSATPTTIKDEAGNLVQIPSAATSSGQYVLPLQNLQNQQIFSVAPGSDSSNGTVSSVQYQVIPQIQSADGQQVQIGFTGSSDNGGINQESSQIQIIPGSNQTLLASGTPSANIQNLIPQTGQVQVQGVAIGGSSFPGQTQVVANVPLGLPGNITFVPINSVDLDSLGLSGSSQTMTAGINADGHLINTGQAMDSSDNSERTGERVSPDINETNTDTDLFVPTSSSSQLPVTIDSTGILQQNTNSLTTSSGQVHSSDLQGNYIQSPVSEETQAQNIQVSTAQPVVQHLQLQESQQPTSQAQIVQGITPQTIHGVQASGQNISQQALQNLQLQLNPGTFLIQAQTVTPSGQVTWQTFQVQGVQNLQNLQIQNTAAQQITLTPVQTLTLGQVAAGGAFTSTPVSLSTGQLPNLQTVTVNSIDSAGIQLHPGENADSPADIRIKEEEPDPEEWQLSGDSTLNTNDLTHLRVQVVDEEGDQQHQEGKRLRRVACTCPNCKEGGGRGTNLGKKKQHICHIPGCGKVYGKTSHLRAHLRWHSGERPFVCNWMYCGKRFTRSDELQRHRRTHTGEKKFVCPECSKRFMRSDHLAKHIKTHQNKKGIHSSSTVLASVEAARDDTLITAGGTTLILANIQQGSVSGIGTVNTSATSNQDILTNTEIPLQLVTVSGNETME

SEQ ID NO: 15677 - protein, 784 aa, Homo Sapiens
MSDQKKEEEEEAAAAAAMATEGGKTSEPENNNKKPKTSGSQDSQPSPLALLAATCSKIGTPGENQATGQQQIIIDPSQGLVQLQNQPQQLELVTTQLAGNAWQLVASTPPASKENNVSQPASSSSSSSSSNNGSASPTKTKSGNSSTPGQFQVIQVQNPSGSVQYQVIPQLQTVEGQQIQINPTSSSSLQDLQGQIQLISAGNNQAILTAANRTASGNILAQNLANQTVPVQIRPGVSIPLQLQTLPGTQAQVVTTLPINIGGVTLALPVINNVAAGGGTGQVGQPAATADSGTSNGNQLVSTPTNTTTSASTMPESPSSSTTCTTTASTSLTSSDTLVSSADTGQYASTSASSSERTIEESQTPAATESEAQSSSQLQPNGMQNAQDQSNSLQQVQIVGQPILQQIQIQQPQQQIIQAIPPQSFQLQSGQTIQTIQQQPLQNVQLQAVNPTQVLIRAPTLTPSGQISWQTVQVQNIQSLSNLQVQNAGLSQQLTITPVSSSGGTTLAQIAPVAVAGAPITLNTAQLASVPNLQTVSVANLGAAGVQVQGVPVTITSVAGQQQGQDGVKVQQATIAPVTVAVGGIANATIGAVSPDQLTQVHLQQGQQTSDQEVQPGKRLRRVACSCPNCREGEGRGSNEPGKKKQHICHIEGCGKVYGKTSHLRAHLRWHTGERPFICNWMFCGKRFTRSDELQRHRRTHTGEKRFECPECSKRFMRSDHLSKHVKTHQNKKGGGTALAIVTSGELDSSVTEVLGSPRIVTVAAISQDSNPATPNVSTNMEEF

SEQ ID NO: 15678 - protein, 398 aa, Homo Sapiens
MAAVAVLRNDSLQAFLQDRTPSASPDLGKHSPLALLAATCSRIGQPGAAAPPDFLQVPYDPALGSPSRLFHPWTADMPAHSPGALPPPHPSLGLTPQKTHLQPSFGAAHELPLTPPADPSYPYEFSPVKMLPSSMAALPASCAPAYVPYAAQAALPPGYSNLLPPPPPPPPPPTCRQLSPNPAPDDLPWWSIPQAGAGPGASGVPGSGLSGACAGAPHAPRFPASAAAAAAAAAALQRGLVLGPSDFAQYQSQIAALLQTKAPLAATARRCRRCRCPNCQAAGGAPEAEPGKKKQHVCHVPGCGKVYGKTSHLKAHLRWHTGERPFVCNWLFCGKSFTRSDELQRHLRTHTGEKRFACPECGKRFMRSDHLAKHVKTHQNKKLKVAEAGVKREDARDL

SEQ ID NO: 15679 - protein, 376 aa, Homo Sapiens
MLTAVCGSLGSQHTEAPHASPPRLDLQPLQTYQGHTSPEAGDYPSPLQPGELQSLPLGPEVDFSQGYELPGASSRVTCEDLESDSPLAPGPFSKLLQPDMSHHYESWFRPTHPGAEDGSWWDLHPGTSWMDLPHTQGALTSPGHPGALQAGLGGYVGDHQLCAPPPHPHAHHLLPAAGGQHLLGPPDGAKALEVAAPESQGLDSSLDGAARPKGSRRSVPRSSGQTVCRCPNCLEAERLGAPCGPDGGKKKHLHNCHIPGCGKAYAKTSHLKAHLRWHSGDRPFVCNWLFCGKRFTRSDELQRHLQTHTGTKKFPCAVCSRVFMRSDHLAKHMKTHEGAKEEAAGAASGEGKAGGAVEPPGGKGKREAEGSVAPSN

SEQ ID NO: 15680 - protein, 431 aa, Homo Sapiens
MASSLLEEEVHYGSSPLAMLTAACSKFGGSSPLRDSTTLGKAGTKKPYSVGSDLSASKTMGDAYPAPFTSTNGLLSPAGSPPAPTSGYANDYPPFSHSFPGPTGTQDPGLLVPKGHSSSDCLPSVYTSLDMTHPYGSWYKAGIHAGISPGPGNTPTPWWDMHPGGNWLGGGQGQGDGLQGTLPTGPAQPPLNPQLPTYPSDFAPLNPAPYPAPHLLQPGPQHVLPQDVYKPKAVGNSGQLEGSGGAKPPRGASTGGSGGYGGSGAGRSSCDCPNCQELERLGAAAAGLRKKPIHSCHIPGCGKVYGKASHLKAHLRWHTGERPFVCNWLFCGKRFTRSDELERHVRTHTREKKFTCLLCSKRFTRSDHLSKHQRTHGEPGPGPPPSGPKELGEGRSTGEEEASQTPRPSASPATPEKAPGGSPEQSNLLEI

SEQ ID NO: 15681 - protein, 490 aa, Homo Sapiens
MLAATCNKIGSPSPSPSSLSDSSSSFGKGFHPWKRSSSSSSASCNVVGSSLSSFGVSGASRNGGSSSAAAAAAAAAAAAAALVSDSFSCGGSPGSSAFSLTSSSAAAAAAAAAAAASSSPFANDYSVFQAPGVSGGSGGGGGGGGGGSSAHSQDGSHQPVFISKVHTSVDGLQGIYPRVGMAHPYESWFKPSHPGLGAAGEVGSAGASSWWDVGAGWIDVQNPNSAAALPGSLHPAAGGLQTSLHSPLGGYNSDYSGLSHSAFSSGASSHLLSPAGQHLMDGFKPVLPGSYPDSAPSPLAGAGGSMLSAGPSAPLGGSPRSSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHVKTHSGGGGGGGSAGSGSGGKKGSDTDSEHSAAGSPPCHSPELLQPPEPGHRNGLE

SEQ ID NO: 15682 - protein, 484 aa, Homo Sapiens
MATSILGEEPRFGTTPLAMLAATCNKIGNTSPLTTLPESSAFAKGGFHPWKRSSSSCNLGSSLSGFAVATGGRGSGGLAGGSGAANSAFCLASTSPTSSAFSSDYGGLFSNSAAAAAAAAGVSPQEAGGQSAFISKVHTTAADGLYPRVGMAHPYESWYKSGFHSTLAAGEVTNGAASSWWDVHSSPGSWLEVQNPAGGLQSSLHSGAPQASLHSQLGTYNPDFSSLTHSAFSSTGLGSSAAAASHLLSTSQHLLAQDGFKPVLPSYSDSSAAVAAAAASAMISGAAAAAAGGSSARSARRYSGRATCDCPNCQEAERLGPAGASLRRKGLHSCHIPGCGKVYGKTSHLKAHLRWHTGERPFVCNWLFCGKRFTRSDELQRHLRTHTGEKRFACPVCNKRFMRSDHLSKHIKTHNGGGGGKKGSDSDTDASNLETPRSESPDLILHDSGVSAARAAAAAAAAAAAAAAAASAGGKEAASGPNDS

SEQ ID NO: 15683 - protein, 335 aa, Homo Sapiens
MGSASPGLSSVSPSHLLLPPDTVSRTGLEKAAAGAVGLERRDWSPSPPATPEQGLSAFYLSYFDMLYPEDSSWAAKAPGASSREEPPEEPEQCPVIDSQAPAGSLDLVPGGLTLEEHSLEQVQSMVVGEVLKDIETACKLLNITADPMDWSPSNVQKWLLWTEHQYRLPPMGKAFQELAGKELCAMSEEQFRQRSPLGGDVLHAHLDIWKSAAWMKERTSPGAIHYCASTSEESWTDSEVDSSCSGQPIHLWQFLKELLLKPHSYGRFIRWLNKEKGIFKIEDSAQVARLWGIRKNRPAMNYDKLSRSIRQYYKKGIIRKPDISQRLVYQFVHPI

SEQ ID NO: 15684 - protein, 270 aa, Homo Sapiens
MLQACKMEGFPLVPPPSEDLVPYDTDLYQRQTHEYYPYLSSDGESHSDHYWDFHPHHVHSEFESFAENNFTELQSVQPPQLQQLYRHMELEQMHVLDTPMVPPHPSLGHQVSYLPRMCLQYPSLSPAQPSSDEEEGERQSPPLEVSDGEADGLEPGPGLLPGETGSKKKIRLYQFLLDLLRSGDMKDSIWWVDKDKGTFQFSSKHKEALAHRWGIQKGNRKKMTYQKMARALRNYGKTGEVKKVKKKLTYQFSGEVLGRGGLAERRHPPH

SEQ ID NO: 15685 - protein, 262 aa, Homo Sapiens
MLALEAAQLDGPHFSCLYPDGVFYDLDSCKHSSYPDSEGAPDSLWDWTVAPPVPATPYEAFDPAAAAFSHPQAAQLCYEPPTYSPAGNLELAPSLEAPGPGLPAYPTENFASQTLVPPAYAPYPSPVLSEEEDLPLDSPALEVSDSESDEALVAGPEGKGSEAGTRKKLRLYQFLLGLLTRGDMRECVWWVEPGAGVFQFSSKHKELLARRWGQQKGNRKRMTYQKLARALRNYAKTGEIRKVKRKLTYQFDSALLPAVRRA

SEQ ID NO: 15686 - protein, 248 aa, Homo Sapiens
MTCVEQDKLGQAFEDAFEVLRQHSTGDLQYSPDYRNYLALINHRPHVKGNSSCYGVLPTEEPVYNWRTVINSAADFYFEGNIHQSLQNITENQLVQPTLLQQKGGKGRKKLRLFEYLHESLYNPEMASCIQWVDKTKGIFQFVSKNKEKLAELWGKRKGNRKTMTYQKMARALRNYGRSGEITKIRRKLTYQFSEAILQRLSPSYFLGKEIFYSQCVQPDQEYLSLNNWNANYNYTYANYHELNHHDC

SEQ ID NO: 15687 - protein, 430 aa, Homo Sapiens
MASSAKSAEMPTISKTVNPTPDPHQEYLDPRITIALFEIGSHSPSSWGSLPFLKNSSHQVTEQQTAQKFNNLLKEIKDILKNMAGFEEKITEAKELFEETNITEDVSAHKENIRGLDKINEMLSTNLPVSLAPEKEDNEKKQEMILETNITEDVSAHKENIRGLDKINEMLSTNLPVSLAPEKEDNEKKQQMIMENQNSENTAQVFARDLVNRLEEKKVLNETQQSQEKAKNRLNVQEETMKIRNNMEQLLQEAEHWSKQHTELSKLIKSYQKSQKDISETLGNNGVGFQTQPNNEVSAKHELEEQVKKLSHDTYSLQLMAALLENECQILQQRVEILKELHHQKQGTLQEKPIQINYKQDKKNQKPSEAKKVEMYKQNKQAMKGTFWKKDRSCRSLDVCLNKKACNTQFNIHVARKALRGKMRSASSLR

SEQ ID NO: 15688 - protein, 1147 aa, Homo Sapiens
MDEPPFSEAALEQALGEPCDLDAALLTDIEDMLQLINNQDSDFPGLFDPPYAGSGAGGTDPASPDTSSPGSLSPPPATLSSSLEAFLSGPQAAPSPLSPPQPAPTPLKMYPSMPAFSPGPGIKEESVPLSILQTPTPQPLPGALLPQSFPAPAPPQFSSTPVLGYPSPPGGFSTGSPPGNTQQPLPGLPLASPPGVPPVSLHTQVQSVVPQQLLTVTAAPTAAPVTTTVTSQIQQVPVLLQPHFIKADSLLLTAMKTDGATVKAAGLSPLVSGTTVQTGPLPTLVSGGTILATVPLVVDAEKLPINRLAAGSKAPASAQSRGEKRTAHNAIEKRYRSSINDKIIELKDLVVGTEAKLNKSAVLRKAIDYIRFLQHSNQKLKQENLSLRTAVHKSKSLKDLVSACGSGGNTDVLMEGVKTEVEDTLTPPPSDAGSPFQSSPLSLGSRGSGSGGSGSDSEPDSPVFEDSKAKPEQRPSLHSRGMLDRSRLALCTLVFLCLSCNPLASLLGARGLPSPSDTTSVYHSPGRNVLGTESRDGPGWAQWLLPPVVWLLNGLLVLVSLVLLFVYGEPVTRPHSGPAVYFWRHRKQADLDLARGDFAQAAQQLWLALRALGRPLPTSHLDLACSLLWNLIRHLLQRLWVGRWLAGRAGGLQQDCALRVDASASARDAALVYHKLHQLHTMGKHTGGHLTATNLALSALNLAECAGDAVSVATLAEIYVAAALRVKTSLPRALHFLTRFFLSSARQACLAQSGSVPPAMQWLCHPVGHRFFVDGDWSVLSTPWESLYSLAGNPVDPLAQVTQLFREHLLERALNCVTQPNPSPGSADGDKEFSDALGYLQLLNSCSDAAGAPAYSFSISSSMATTTGVDPVAKWWASLTAVVIHWLRRDEEAAERLCPLVEHLPRVLQESERPLPRAALHSFKAARALLGCAKAESGPASLTICEKASGYLQDSLATTPASSSIDKAVQLFLCDLLLVVRTSLWRQQQPPAPAPAAQGTSSRPQASALELRGFQRDLSSLRRLAQSFRPAMRRVFLHEATARLMAGASPTRTHQLLDRSLRRRAGPGGKGGAVAELEPRPTRREHAEALLLASCYLPPGFLSAPGQRVGMLAEAARTLEKLGDRRLLHDCQQMLMRLGGGTTVTSS

SEQ ID NO: 15689 - protein, 1141 aa, Homo Sapiens
MDDSGELGGLETMETLTELGDELTLGDIDEMLQFVSNQVGEFPDLFSEQLCSSFPGSGGSGSSSGSSGSSSSSSNGRGSSSGAVDPSVQRSFTQVTLPSFSPSAASPQAPTLQVKVSPTSVPTTPRATPILQPRPQPQPQPQTQLQQQTVMITPTFSTTPQTRIIQQPLIYQNAATSFQVLQPQVQSLVTSSQVQPVTIQQQVQTVQAQRVLTQTANGTLQTLAPATVQTVAAPQVQQVPVLVQPQIIKTDSLVLTTLKTDGSPVMAAVQNPALTALTTPIQTAALQVPTLVGSSGTILTTMPVMMGQEKVPIKQVPGGVKQLEPPKEGERRTTHNIIEKRYRSSINDKIIELKDLVMGTDAKMHKSGVLRKAIDYIKYLQQVNHKLRQENMVLKLANQKNKLLKGIDLGSLVDNEVDLKIEDFNQNVLLMSPPASDSGSQAGFSPYSIDSEPGSPLLDDAKVKDEPDSPPVALGMVDRSRILLCVLTFLCLSFNPLTSLLQWGGAHDSDQHPHSGSGRSVLSFESGSGGWFDWMMPTLLLWLVNGVIVLSVFVKLLVHGEPVIRPHSRSSVTFWRHRKQADLDLARGDFAAAAGNLQTCLAVLGRALPTSRLDLACSLSWNVIRYSLQKLRLVRWLLKKVFQCRRATPATEAGFEDEAKTSARDAALAYHRLHQLHITGKLPAGSACSDVHMALCAVNLAECAEEKIPPSTLVEIHLTAAMGLKTRCGGKLGFLASYFLSRAQSLCGPEHSAVPDSLRWLCHPLGQKFFMERSWSVKSAAKESLYCAQRNPADPIAQVHQAFCKNLLERAIESLVKPQAKKKAGDQEEESCEFSSALEYLKLLHSFVDSVGVMSPPLSRSSVLKSALGPDIICRWWTSAITVAISWLQGDDAAVRSHFTKVERIPKALEVTESPLVKAIFHACRAMHASLPGKADGQQSSFCHCERASGHLWSSLNVSGATSDPALNHVVQLLTCDLLLSLRTALWQKQASASQAVGETYHASGAELAGFQRDLGSLRRLAHSFRPAYRKVFLHEATVRLMAGASPTRTHQLLEHSLRRRTTQSTKHGEVDAWPGQRERATAILLACRHLPLSFLSSPGQRAVLLAEAARTLEKVGDRRSCNDCQQMIVKLGGGTAIAAS

SEQ ID NO: 15690 - protein, 508 aa, Homo Sapiens
MLPTQAGAAAALGRGSALGGSLNRTPTGRPGGGGGTRGANGGRVPGNGAGLGPGRLEREAAAAAATTPAPTAGALYSGSEGDSESGEEEELGAERRGLKRSLSEMEIGMVVGGPEASAAATGGYGPVSGAVSGAKPGKKTRGRVKIKMEFIDNKLRRYTTFSKRKTGIMKKAYELSTLTGTQVLLLVASETGHVYTFATRKLQPMITSETGKALIQTCLNSPDSPPRSDPTTDQRMSATGFEETDLTYQVSESDSSGETKDTLKPAFTVTNLPGTTSTIQTAPSTSTTMQVSSGPSFPITNYLAPVSASVSPSAVSSANGTVLKSTGSGPVSSGGLMQLPTSFTLMPGGAVAQQVPVQAIQVHQAPQQASPSRDSSTDLTQTSSSGTVTLPATIMTSSVPTTVGGHMMYPSPHAVMYAPTSGLGDGSLTVLNAFSQAPSTMQVSHSQVQEPGGVPQVFLTASSGTVQIPVSAVQLHQMAVIGQQAGSSSNLTELQVVNLDTAHSTKSE

SEQ ID NO: 15691 - protein, 204 aa, Homo Sapiens
MQSYASAMLSVFNSDDYSPAVQENIPALRRSSSFLCTESCNSKYQCETGENSKGNVQDRVKRPMNAFIVWSRDQRRKMALENPRMRNSEISKQLGYQWKMLTEAEKWPFFQEAQKLQAMHREKYPNYKYRPRRKAKMLPKNCSLLPADPASVLCSEVQLDNRLYRDDCTKATHSRMEHQLGHLPPINAASSPQQRDRYSHWTKL

SEQ ID NO: 15692 - protein, 709 aa, Homo Sapiens
MAETLEFNDVYQEVKGSMNDGRLRLSRQGIIFKNSKTGKVDNIQAGELTEGIWRRVALGHGLKLLTKNGHVYKYDGFRESEFEKLSDFFKTHYRLELMEKDLCVKGWNWGTVKFGGQLLSFDIGDQPVFEIPLSNVSQCTTGKNEVTLEFHQNDDAEVSLMEVRFYVPPTQEDGVDPVEAFAQNVLSKADVIQATGDAICIFRELQCLTPRGRYDIRIYPTFLHLHGKTFDYKIPYTTVLRLFLLPHKDQRQMFFVISLDPPIKQGQTRYHFLILLFSKDEDISLTLNMNEEEVEKRFEGRLTKNMSGSLYEMVSRVMKALVNRKITVPGNFQGHSGAQCITCSYKASSGLLYPLERGFIYVHKPPVHIRFDEISFVNFARGTTTTRSFDFEIETKQGTQYTFSSIEREEYGKLFDFVNAKKLNIKNRGLKEGMNPSYDEYADSDEDQHDAYLERMKEEGKIREENANDSSDDSGEETDESFNPGEEEEDVAEEFDSNASASSSSNEGDSDRDEKKRKQLKKAKMAKDRKSRKKPVEVKKGKDPNAPKRPMSAYMLWLNASREKIKSDHPGISITDLSKKAGEIWKGMSKEKKEEWDRKAEDARRDYEKAMKEYEGGRGESSKRDKSKKKKKVKVKMEKKSTPSRGSSSKSSSRQLSESFKSKEFVSSDESSSGENKSKKKRRRSEDSEEEELASTPPSSEDSASGSDE

SEQ ID NO: 15693 - protein, 1047 aa, Homo Sapiens
MDAEAEDKTLRTRSKGTEVPMDSLIQELSVAYDCSMAKKRTAEDQALGVPVNKRKSLLMKPRHYSPKADCQEDRSDRTEDDGPLETHGHSTAEEIMIKPMDESLLSTAQENSSRKEDRYSCYQELMVKSLMHLGKFEKNVSVQTVSENLNDSGIQSLKAESDEADECFLIHSDDGRDKIDDSQPPFCSSDDNESNSESAENGWDSGSNFSEETKPPRVPKYVLTDHKKDLLEVPEIKTEGDKFIPCENRCDSETERKDPQNALAEPLDGNAQPSFPDVEEEDSESLAVMTEEGSDLEKAKGNLSLLEQAIALQAERGCVFHNTYKELDRFLLEHLAGERRQTKVIDMGGRQIFNNKHSPRPEKRETKCPIPGCDGTGHVTGLYPHHRSLSGCPHKVRVPLEILAMHENVLKCPTPGCTGRGHVNSNRNTHRSLSGCPIAAAEKLAMSQDKNQLDSPQTGQCPDQAHRTSLVKQIEFNFPSQAITSPRATVSKEQEKFGKVPFDYASFDAQVFGKRPLIQTVQGRKTPPFPESKHFPNPVKFPNRLPSAGAHTQSPGRASSYSYGQCSEDTHIAAAAAILNLSTRCREATDILSNKPQSLHAKGAEIEVDENGTLDLSMKKNRILDKSAPLTSSNTSIPTPSSSPFKTSSILVNAAFYQALCDQEGWDTPINYSKTHGKTEEEKEKDPVSSLENLEEKKFPGEASIPSPKPKLHARDLKKELITCPTPGCDGSGHVTGNYASHRSVSGCPLADKTLKSLMAANSQELKCPTPGCDGSGHVTGNYASHRSLSGCPRARKGGVKMTPTKEEKEDPELKCPVIGCDGQGHISGKYTSHRTASGCPLAAKRQKENPLNGASLSWKLNKQELPHCPLPGCNGLGHVNNVFVTHRSLSGCPLNAQVIKKGKVSEELMTIKLKATGGIESDEEIRHLDEEIKELNESNLKIEADMMKLQTQITSMESNLKTIEEENKLIEQNNESLLKELAGLSQALISSLADIQLPQMGPISEQNFEAYVNTLTDMYSNLERDYSPECKALLESIKQAVKGIHV

SEQ ID NO: 15694 - protein, 750 aa, Homo Sapiens
MSQWYELQQLDSKFLEQVHQLYDDSFPMEIRQYLAQWLEKQDWEHAANDVSFATIRFHDLLSQLDDQYSRFSLENNFLLQHNIRKSKRNLQDNFQEDPIQMSMIIYSCLKEERKILENAQRFNQAQSGNIQSTVMLDKQKELDSKVRNVKDKVMCIEHEIKSLEDLQDEYDFKCKTLQNREHETNGVAKSDQKQEQLLLKKMYLMLDNKRKEVVHKIIELLNVTELTQNALINDELVEWKRRQQSACIGGPPNACLDQLQNWFTIVAESLQQVRQQLKKLEELEQKYTYEHDPITKNKQVLWDRTFSLFQQLIQSSFVVERQPCMPTHPQRPLVLKTGVQFTVKLRLLVKLQELNYNLKVKVLFDKDVNERNTVKGFRKFNILGTHTKVMNMEESTNGSLAAEFRHLQLKEQKNAGTRTNEGPLIVTEELHSLSFETQLCQPGLVIDLETTSLPVVVISNVSQLPSGWASILWYNMLVAEPRNLSFFLTPPCARWAQLSEVLSWQFSSVTKRGLNVDQLNMLGEKLLGPNASPDGLIPWTRFCKENINDKNFPFWLWIESILELIKKHLLPLWNDGCIMGFISKERERALLKDQQPGTFLLRFSESSREGAITFTWVERSQNGGEPDFHAVEPYTKKELSAVTFPDIIRNYKVMAAENIPENPLKYLYPNIDKDHAFGKYYSRPKEAPEPMELDGPKGTGYIKTELISVSEVHPSRLQTTDNLLPMSPEEFDEVSRIVGSVEFDSMMNTV

SEQ ID NO: 15695 - protein, 851 aa, Homo Sapiens
MAQWEMLQNLDSPFQDQLHQLYSHSLLPVDIRQYLAVWIEDQNWQEAALGSDDSKATMLFFHFLDQLNYECGRCSQDPESLLLQHNLRKFCRDIQPFSQDPTQLAEMIFNLLLEEKRILIQAQRAQLEQGEPVLETPVESQQHEIESRILDLRAMMEKLVKSISQLKDQQDVFCFRYKIQAKGKTPSLDPHQTKEQKILQETLNELDKRRKEVLDASKALLGRLTTLIELLLPKLEEWKAQQQKACIRAPIDHGLEQLETWFTAGAKLLFHLRQLLKELKGLSCLVSYQDDPLTKGVDLRNAQVTELLQRLLHRAFVVETQPCMPQTPHRPLILKTGSKFTVRTRLLVRLQEGNESLTVEVSIDRNPPQLQGFRKFNILTSNQKTLTPEKGQSQGLIWDFGYLTLVEQRSGGSGKGSNKGPLGVTEELHIISFTVKYTYQGLKQELKTDTLPVVIISNMNQLSIAWASVLWFNLLSPNLQNQQFFSNPPKAPWSLLGPALSWQFSSYVGRGLNSDQLSMLRNKLFGQNCRTEDPLLSWADFTKRESPPGKLPFWTWLDKILELVHDHLKDLWNDGRIMGFVSRSQERRLLKKTMSGTFLLRFSESSEGGITCSWVEHQDDDKVLIYSVQPYTKEVLQSLPLTEIIRHYQLLTEENIPENPLRFLYPRIPRDEAFGCYYQEKVNLQERRKYLKHRLIVVSNRQVDELQQPLELKPEPELESLELELGLVPEPELSLDLEPLLKAGLDLGPELESVLESTLEPVIEPTLCMVSQTVPEPDQGPVSQPVPEPDLPCDLRHLNTEPMEIFRNCVKIEEIMPNGDPLLAGQNTVDEVYVSRPSHFYTDGPLMPSDF

SEQ ID NO: 15696 - protein, 770 aa, Homo Sapiens
MAQWNQLQQLDTRYLEQLHQLYSDSFPMELRQFLAPWIESQDWAYAASKESHATLVFHNLLGEIDQQYSRFLQESNVLYQHNLRRIKQFLQSRYLEKPMEIARIVARCLWEESRLLQTAATAAQQGGQANHPTAAVVTEKQQMLEQHLQDVRKRVQDLEQKMKVVENLQDDFDFNYKTLKSQGDMQDLNGNNQSVTRQKMQQLEQMLTALDQMRRSIVSELAGLLSAMEYVQKTLTDEELADWKRRQQIACIGGPPNICLDRLENWITSLAESQLQTRQQIKKLEELQQKVSYKGDPIVQHRPMLEERIVELFRNLMKSAFVVERQPCMPMHPDRPLVIKTGVQFTTKVRLLVKFPELNYQLKIKVCIDKDSGDVAALRGSRKFNILGTNTKVMNMEESNNGSLSAEFKHLTLREQRCGNGGRANCDASLIVTEELHLITFETEVYHQGLKIDLETHSLPVVVISNICQMPNAWASILWYNMLTNNPKNVNFFTKPPIGTWDQVAEVLSWQFSSTTKRGLSIEQLTTLAEKLLGPGVNYSGCQITWAKFCKENMAGKGFSFWVWLDNIIDLVKKYILALWNEGYIMGFISKERERAILSTKPPGTFLLRFSESSKEGGVTFTWVEKDISGKTQIQSVEPYTKQQLNNMSFAEIIMGYKIMDATNILVSPLVYLYPDIPKEEAFGKYCRPESQEHPEADPGSAAPYLKTKFICVTPTTCSNTIDLPMSPRTLDSLMQFGNNGEGAEPSAGGQFESLTFDMELTSECATSPM

SEQ ID NO: 15697 - protein, 748 aa, Homo Sapiens
MSQWNQVQQLEIKFLEQVDQFYDDNFPMEIRHLLAQWIENQDWEAASNNETMATILLQNLLIQLDEQLGRVSKEKNLLLIHNLKRIRKVLQGKFHGNPMHVAVVISNCLREERRILAAANMPVQGPLEKSLQSSSVSERQRNVEHKVAAIKNSVQMTEQDTKYLEDLQDEFDYRYKTIQTMDQSDKNSAMVNQEVLTLQEMLNSLDFKRKEALSKMTQIIHETDLLMNTMLIEELQDWKRRQQIACIGGPLHNGLDQLQNCFTLLAESLFQLRRQLEKLEEQSTKMTYEGDPIPMQRTHMLERVTFLIYNLFKNSFVVERQPCMPTHPQRPLVLKTLIQFTVKLRLLIKLPELNYQVKVKASIDKNVSTLSNRRFVLCGTNVKAMSIEESSNGSLSVEFRHLQPKEMKSSAGGKGNEGCHMVTEELHSITFETQICLYGLTIDLETSSLPVVMISNVSQLPNAWASIIWYNVSTNDSQNLVFFNNPPPATLSQLLEVMSWQFSSYVGRGLNSDQLHMLAEKLTVQSSYSDGHLTWAKFCKEHLPGKSFTFWTWLEAILDLIKKHILPLWIDGYVMGFVSKEKERLLLKDKMPGTFLLRFSESHLGGITFTWVDHSESGEVRFHSVEPYNKGRLSALPFADILRDYKVIMAENIPENPLKYLYPDIPKDKAFGKHYSSQPCEVSRPTERGDKGYVPSVFIPISTIRSDSTEPHSPSDLLPMSPSVYAVLRENLSPTTIETAMKSPYSAE

SEQ ID NO: 15698 - protein, 794 aa, Homo Sapiens
MAGWIQAQQLQGDALRQMQVLYGQHFPIEVRHYLAQWIESQPWDAIDLDNPQDRAQATQLLEGLVQELQKKAEHQVGEDGFLLKIKLGHYATQLQKTYDRCPLELVRCIRHILYNEQRLVREANNCSSPAGILVDAMSQKHLQINQTFEELRLVTQDTENELKKLQQTQEYFIIQYQESLRIQAQFAQLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNECSGEILNNCCVMEYHQATGTLSAHFRNMSLKRIKRADRRGAESVTEEKFTVLFESQFSVGSNELVFQVKTLSLPVVVIVHGSQDHNATATVLWDNAFAEPGRVPFAVPDKVLWPQLCEALNMKFKAEVQSNRGLTKENLVFLAQKLFNNSSSHLEDYSGLSVSWSQFNRENLPGWNYTFWQWFDGVMEVLKKHHKPHWNDGAILGFVNKQQAHDLLINKPDGTFLLRFSDSEIGGITIAWKFDSPERNLWNLKPFTTRDFSIRSLADRLGDLSYLIYVFPDRPKDEVFSKYYTPVLAKAVDGYVKPQIKQVVPEFVNASADAGGSSATYMDQAPSPAVCPQAPYNMYPQNPDHVLDQDGEFDLDETMDVARHVEELLRRPMDSLDSRLSPPAGLFTSARGSLS

SEQ ID NO: 15699 - protein, 794 aa, Homo Sapiens; identical to SEQ ID NO: 15698

SEQ ID NO: 15700 - protein, 787 aa, Homo Sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQWKRRQQLAGNGGPPEGSLDVLQSWCEKLAEIIWQNRQQIRRAEHLCQQLPIPGPVEEMLAEVNATITDIISALVTSTFIIEKQPPQVLKTQTKFAATVRLLVGGKLNVHMNPPQVKATIISEQQAKSLLKNENTRNDYSGEILNNCCVMEYHQATGTLSAHFRNMSLKRIKRSDRRGAESVTEEKFTILFESQFSVGGNELVFQVKTLSLPVVVIVHGSQDNNATATVLWDNAFAEPGRVPFAVPDKVLWPQLCEALNMKFKAEVQSNRGLTKENLVFLAQKLFNNSSSHLEDYSGLSVSWSQFNRENLPGRNYTFWQWFDGVMEVLKKHLKPHWNDGAILGFVNKQQAHDLLINKPDGTFLLRFSDSEIGGITIAWKFDSQERMFWNLMPFTTRDFSIRSLADRLGDLNYLIYVFPDRPKDEVYSKYYTPVPCESATAKAVDGYVKPQIKQVVPEFVNASADAGGGSATYMDQAPSPAVCPQAHYNMYPQNPDSVLDTDGDFDLEDTMDVARRVEELLGRPMDSQWIPHAQS

SEQ ID NO: 15701 - protein, 847 aa, Homo Sapiens
MSLWGLVSKMPPEKVQRLYVDFPQHLRHLLGDWLESQPWEFLVGSDAFCCNLASALLSDTVQHLQASVGEQGEGSTILQHISTLESIYQRDPLKLVATFRQILQGEKKAVMEQFRHLPMPFHWKQEELKFKTGLRRLQHRVGEIHLLREALQKGAEAGQVSLHSLIETPANGTGPSEALAMLLQETTGELEAAKALVLKRIQIWKRQQQLAGNGAPFEESLAPLQERCESLVDIYSQLQQEVGAAGGELEPKTRASLTGRLDEVLRTLVTSCFLVEKQPPQVLKTQTKFQAGVRFLLGLRFLGAPAKPPLVRADMVTEKQARELSVPQGPGAGAESTGEIINNTVPLENSIPGNCCSALFKNLLLKKIKRCERKGTESVTEEKCAVLFSASFTLGPGKLPIQLQALSLPLVVIVHGNQDNNAKATILWDNAFSEMDRVPFVVAERVPWEKMCETLNLKFMAEVGTNRGLLPEHFLFLAQKIFNDNSLSMEAFQHRSVSWSQFNKEILLGRGFTFWQWFDGVLDLTKRCLRSYWSDRLIIGFISKQYVTSLLLNEPDGTFLLRFSDSEIGGITIAHVIRGQDGSPQIENIQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQEPHLQMPPSLGQMSLPFDQPHPQGLLPCQPQEHAVSSPDPLLCSDVTMVEDSCLSQPVTAFPQGTWIGEDIFPPLLPPTEQDLTKLLLEGQGESGGGSLGAQPLLQPSHYGQSGISMSHMDLRANPSW

SEQ ID NO: 15702 - protein, 443 aa, Homo Sapiens
MDRLGPFSNDPSDKPPCRGCSSYLMEPYIKCAECGPPPFFLCLQCFTRGFEYKKHQSDHTYEIMTSDFPVLDPSWTAQEEMALLEAVMDCGFGNWQDVANQMCTKTKEECEKHYMKHFINNPLFASTLLNLKQAEEAKTADTAIPFHSTDDPPRPTFDSLLSRDMAGYMPARADFIEEFDNYAEWDLRDIDFVEDDSDILHALKMAVVDIYHSRLKERQRRKKIIRDHGLINLRKFQLMERRYPKEVQDLYETMRRFARIVGPVEHDKFIESHALEFELRREIKRLQEYRTAGITNFCSARTYDHLKKTREEERLKRTMLSEVLQYIQDSSACQQWLRRQADIDSGLSPSIPMASNSGRRSAPPLNLTGLPGTEKLNEKEKELCQMVRLVPGAYLEYKSALLNECNKQGGLRLAQARALIKIDVNKTRKIYDFLIREGYITKG

SEQ ID NO: 15703 - protein, 420 aa, Homo Sapiens
MAELGKKYCVYCLAEVSPLRFRCTECQDIELCPECFSAGAEIGHHRRYHGYQLVDGGRFTLWGPEAEGGWTSREEQLLLDAIEQFGFGNWEDMAAHVGASRTPQEVMEHYVSMYIHGNLGKACIPDTIPNRVTDHTCPSGGPLSPSLTTPLPPLDISVAEQQQLGYMPLRDDYEIEYDQDAETLISGLSVNYDDDDVEIELKRAHVDMYVRKLKERQRRKNIARDYNLVPAFLGKDKKEKEKALKRKITKEEKELRLKLRPLYQFMSCKEFDDLFENMHKEKMLRAKIRELQRYRRNGITKMEESAEYEAARHKREKRKENKNLAGSKRGKEDGKDSEFAAIENLPGFELLSDREKVLCSSLNLSPARYVTVKTIIIKDHLQKRQGIPSKSRLPSYLDKVLKKRILNFLTESGWISRDAS

SEQ ID NO: 15704 - protein, 1872 aa, Homo Sapiens
MGPGCDLLLRTAATITAAAIMSDTDSDEDSAGGGPFSLAGFLFGNINGAGQLEGESVLDDECKKHLAGLGALGLGSLITELTANEELTGTDGALVNDEGWVRSTEDAVDYSDINEVAEDESRRYQQTMGSLQPLCHSDYDEDDYDADCEDIDCKLMPPPPPPPGPMKKDKDQDSITGEKVDFSSSSDSESEMGPQEATQAESEDGKLTLPLAGIMQHDATKLLPSVTELFPEFRPGKVLRFLRLFGPGKNVPSVWRSARRKRKKKHRELIQEEQIQEVECSVESEVSQKSLWNYDYAPPPPPEQCLSDDEITMMAPVESKFSQSTGDIDKVTDTKPRVAEWRYGPARLWYDMLGVPEDGSGFDYGFKLRKTEHEPVIKSRMIEEFRKLEENNGTDLLADENFLMVTQLHWEDDIIWDGEDVKHKGTKPQRASLAGWLPSSMTRNAMAYNVQQGFAATLDDDKPWYSIFPIDNEDLVYGRWEDNIIWDAQAMPRLLEPPVLTLDPNDENLILEIPDEKEEATSNSPSKESKKESSLKKSRILLGKTGVIKEEPQQNMSQPEVKDPWNLSNDEYYYPKQQGLRGTFGGNIIQHSIPAVELRQPFFPTHMGPIKLRQFHRPPLKKYSFGALSQPGPHSVQPLLKHIKKKAKMREQERQASGGGEMFFMRTPQDLTGKDGDLILAEYSEENGPLMMQVGMATKIKNYYKRKPGKDPGAPDCKYGETVYCHTSPFLGSLHPGQLLQAFENNLFRAPIYLHKMPETDFLIIRTRQGYYIRELVDIFVVGQQCPLFEVPGPNSKRANTHIRDFLQVFIYRLFWKSKDRPRRIRMEDIKKAFPSHSESSIRKRLKLCADFKRTGMDSNWWVLKSDFRLPTEEEIRAMVSPEQCCAYYSMIAAEQRLKDAGYGEKSFFAPEEENEEDFQMKIDDEVRTAPWNTTRAFIAAMKGKCLLEVTGVADPTGCGEGFSYVKIPNKPTQQKDDKEPQPVKKTVTGTDADLRRLSLKNAKQLLRKFGVPEEEIKKLSRWEVIDVVRTMSTEQARSGEGPMSKFARGSRFSVAEHQERYKEECQRIFDLQNKVLSSTEVLSTDTDSSSAEDSDFEEMGKNIENMLQNKKTSSQLSREREEQERKELQRMLLAAGSAASGNNHRDDDTASVTSLNSSATGRCLKIYRTFRDEEGKEYVRCETVRKPAVIDAYVRIRTTKDEEFIRKFALFDEQHREEMRKERRRIQEQLRRLKRNQEKEKLKGPPEKKPKKMKERPDLKLKCGACGAIGHMRTNKFCPLYYQTNAPPSNPVAMTEEQEEELEKTVIHNDNEELIKVEGTKIVLGKQLIESADEVRRKSLVLKFPKQQLPPKKKRRVGTTVHCDYLNRPHKSIHRRRTDPMVTLSSILESIINDMRDLPNTYPFHTPVNAKVVKDYYKIITRPMDLQTLRENVRKRLYPSREEFREHLELIVKNSATYNGPKHSLTQISQSMLDLCDEKLKEKEDKLARLEKAINPLLDDDDQVAFSFILDNIVTQKMMAVPDSWPFHHPVNKKFVPDYYKVIVNPMDLETIRKNISKHKYQSRESFLDDVNLILANSVKYNGPESQYTKTAQEIVNVCYQTLTEYDEHLTQLEKDICTAKEAALEEAELESLDPMTPGPYTPQPPDLYDTNTSLSMSRDASVFQDESNMSVLDIPSATPEKQVTQEGEDGDGDLADEEEGTVQQPQASVLYEDLLMSEGEDDEEDAGSDEEGDNPFSAIQLSESGSDSDVGSGGIRPKQPRMLQENTRMDMENEESMMSYEGDGGEASHGLEDSNISYGSYEEPDPKSNTQDTSFSSIGGYEVSEEEEDEEEEEQRSGPSVLSQVHLSEDEEDSEDFHSIAGDSDLDSDE

SEQ ID NO: 15705 - protein, 331 aa, Homo Sapiens
MTERPPSEAARSDPQLEGRDAAEASMAPPHLVLLNGVAKETSRAAAAEPPVIELGARGGPGGGPAGGGGAARDLKGRDAATAEARHRVPTTELCRPPGPAPAPAPASVTAELPGDGRMVQLSPPALAAPAAPGRALLYSLSQPLASLGSGFFGEPDAFPMFTTNNRVKRRPSPYEMEITDGPHTKVVRRIFTNSRERWRQQNVNGAFAELRKLIPTHPPDKKLSKNEILRLAMKYINFLAKLLNDQEEEGTQRAKTGKDPVVGAGGGGGGGGGGAPPDDLLQDVLSPNSSCGSSLDGAASPDSYTEEPAPKHTARSLHPAMLPAADGAGPR

SEQ ID NO: 15706 - protein, 108 aa, Homo Sapiens
MTRKIFTNTRERWRQQNVNSAFAKLRKLIPTHPPDKKLSKNETLRLAMRYINFLVKVLGEQSLQQTGVAAQGNILGLFPQGPHLPGLEDRTLLENYQVPSPGPSHHIP

SEQ ID NO: 15707 - protein, 789 aa, Homo Sapiens
MTSFQEVPLQTSNFAHVIFQNVAKSYLPNAHLECHYTLTPYIHPHPKDWVGIFKVGWSTARDYYTFLWSPMPEHYVEGSTVNCVLAFQGYYLPNDDGEFYQFCYVTHKGEIRGASTPFQFRASSPVEELLTMEDEGNSDMLVVTTKAGLLELKIEKTMKEKEELLKLIAVLEKETAQLREQVGRMERELNHEKERCDQLQAEQKGLTEVTQSLKMENEEFKKRFSDATSKAHQLEEDIVSVTHKAIEKETELDSLKDKLKKAQHEREQLECQLKTEKDEKELYKVHLKNTEIENTKLMSEVQTLKNLDGNKESVITHFKEEIGRLQLCLAEKENLQRTFLLTTSSKEDTCFLKEQLRKAEEQVQATRQEVVFLAKELSDAVNVRDRTMADLHTARLENEKVKKQLADAVAELKLNAMKKDQDKTDTLEHELRREVEDLKLRLQMAADHYKEKFKECQRLQKQINKLSDQSANNNNVFTKKTGNQQKVNDASVNTDPATSASTVDVKPSPSAAEADFDIVTKGQVCEMTKEIADKTEKYNKCKQLLQDEKAKCNKYADELAKMELKWKEQVKIAENVKLELAEVQDNYKELKRSLENPAERKMEGQNSQSPQCFKTCSEQNGYVLTLSNAQPVLQYGNPYASQETRDGADGAFYPDEIQRPPVRVPSWGLEDNVVCSQPARNFSRPDGLEDSEDSKEDENVPTAPDPPSQHLRGHGTGFCFDSSFDVHKKCPLCELMFPPNYDQSKFEEHVESHWKVCPMCSEQFPPDYDQQVFERHVQTHFDQNVLNFD

SEQ ID NO: 15708 - protein, 124 aa, Homo Sapiens
MSYIPGQPVTAVVQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 15709 - protein, 535 aa, Homo Sapiens
MGIVEPGCGDMLTGTEPMPGSDEGRAPGADPQHRYFYPEPGAQDADERRGGGSLGSPYPGGALVPAPPSRFLGAYAYPPRPQAAGFPGAGESFPPPADAEGYQPGEGYAAPDPRAGLYPGPREDYALPAGLEVSGKLRVALNNHLLWSKFNQHQTEMIITKQGRRMFPFLSFTVAGLEPTSHYRMFVDVVLVDQHHWRYQSGKWVQCGKAEGSMPGNRLYVHPDSPNTGAHWMRQEVSFGKLKLTNNKGASNNVTQMIVLQSLHKYQPRLHIVEVNDGEPEAACNASNTHIFTFQETQFIAVTAYQNAEITQLKIDNNPFAKGFRENFESMYTSVDTSIPSPPGPNCQFLGGDHYSPLLPNQYPVPSRFYPDLPGQAKDVVPQAYWLGAPRDHSYEAEFRAVSMKPAFLPSAPGPTMSYYRGQEVLAPGAGWPVAPQYPPKMGPASWFRPMRTLPMEPGPGGSEGRGPEDQGPPLVWTEIAPIRPESSDSGLGEGDSKRRRVSPYPSSGDSSSPAGAPSPFDKEAEGQFYNYFPN

SEQ ID NO: 15710 - protein, 339 aa, Homo Sapiens
MDQNNSLPPYAQGLASPQGAMTPGIPIFSPMMPYGTGLTPQPIQNTNSLSILEEQQRQQQQQQQQQQQQQQQQQQQQQQQQQQQQQQQQQQQQQQAVAAAAVQQSTSQQATQGTSGQAPQLFHSQTLTTAPLPGTTPLYPSPMTPMTPITPATPASESSGIVPQLQNIVSTVNLGCKLDLKTIALRARNAEYNPKRFAAVIMRIREPRTTALIFSSGKMVCTGAKSEEQSRLAARKYARVVQKLGFPAKFLDFKIQNMVGSCDVKFPIRLEGLVLTHQQFSSYEPELFPGLIYRMIKPRIVLLIFVSGKVVLTGAKVRAEIYEAFENIYPILKGFRKTT

SEQ ID NO: 15711 - protein, 186 aa, Homo Sapiens
MDADSDVALDILITNVVCVFRTRCHLNLRKIALEGANVIYKRDVGKVLMKLRKPRITATIWSSGKIICTGATSEEEAKFGARRLARSLQKLGFQVIFTDFKVVNVLAVCNMPFEIRLPEFTKNNRPHASYEPELHPAVCYRIKSLRATLQIFSTGSITVTGPNVKAVATAVEQIYPFVFESRKEIL

SEQ ID NO: 15712 - protein, 375 aa, Homo Sapiens
MASAPWPERVPRLLAPRLPSYPPPPPTVGLRSMEQEETYLELYLDQCAAQDGLAPPRSPLFSPVVPYDMYILNASNPDTAFNSNPEVKETSGDFSSVDLSFLPDEVTQENKDQPVISKHETEENSESQSPQSRLPSPSEQDVGLGLNSSSLSNSHSQLHPGDTDSVQPSPEKPNSDSLSLASITPMTPMTPISECCGIVPQLQNIVSTVNLACKLDLKKIALHAKNAEYNPKRFAAVIMRIREPRTTALIFSSGKMVCTGAKSEEQSRLAARKYARVVQKLGFPARFLDFKIQNMVGSCDVRFPIRLEGLVLTHQQFSSYEPELFPGLIYRMVKPRIVLLIFVSGKVVLTGAKERSEIYEAFENIYPILKGFKKA

SEQ ID NO: 15713 - protein, 682 aa, Homo Sapiens
MQLEHCLSPSIMLSKKFLNVSSSYPHSGGSELVLHDHPIISTTDNLERSSPLKKITRGMTNQSDTDNFPDSKDSPGDVQRSKLSPVLDGVSELRHSFDGSAADRYLLSQSSQPQSAATAPSAMFPYPGQHGPAHPAFSIGSPSRYMAHHPVITNGAYNSLLSNSSPQGYPTAGYPYPQQYGHSYQGAPFYQFSSTQPGLVPGKAQVYLCNRPLWLKFHRHQTEMIITKQGRRMFPFLSFNISGLDPTAHYNIFVDVILADPNHWRFQGGKWVPCGKADTNVQGNRVYMHPDSPNTGAHWMRQEISFGKLKLTNNKGASNNNGQMVVLQSLHKYQPRLHVVEVNEDGTEDTSQPGRVQTFTFPETQFIAVTAYQNTDITQLKIDHNPFAKGFRDNYDTIYTGCDMDRLTPSPNDSPRSQIVPGARYAMAGSFLQDQFVSNYAKARFHPGAGAGPGPGTDRSVPHTNGLLSPQQAEDPGAPSPQRWFVTPANNRLDFAASAYDTATDFAGNAATLLSYAAAGVKALPLQAAGCTGRPLGYYADPSGWGARSPPQYCGTKSGSVLPCWPNSAAAAARMAGANPYLGEEAEGLAAERSPLPPGAAEDAKPKDLSDSSWIETPSSIKSIDSSDSGIYEQAKRRRISPADTPVSESSSPLKSEVLAQRDCEKNCAKDISGYYGFYSHS

SEQ ID NO: 15714 - protein, 398 aa, Homo Sapiens
MHFSTVTRDMEAFTASSLSSLGAAGGFPGAASPGADPYGPREPPPPPPRYDPCAAAAPGAPGPPPPPHAYPFAPAAGAATSAAAEPEGPGASCAAAAKAPVKKNAKVAGVSVQLEMKALWDEFNQLGTEMIVTKAGRRMFPTFQVKLFGMDPMADYMLLMDFVPVDDKRYRYAFHSSSWLVAGKADPATPGRVHYHPDSPAKGAQWMKQIVSFDKLKLTNNLLDDNGHIILNSMHRYQPRFHVVYVDPRKDSEKYAEENFKTFVFEETRFTAVTAYQNHRITQLKIASNPFAKGFRDCDPEDWPRNHRPGALPLMSAFARSRNPVASPTQPSGTEKGGHVLKDKEVKAETSRNTPEREVELLRDAGGCVNLGLPCPAECQPFNTQGLVAGRTAGDRLC

SEQ ID NO: 15715 - protein, 385 aa, Homo Sapiens; identical to SEQ ID NO: 13037

SEQ ID NO: 15716 - protein, 602 aa, Homo Sapiens
MSERRRSAVALSSRAHAFSVEALIGSNKKRKLRDWEEKGLDLSMEALSPAGPLGDTEDAAAHGLEPHPDSEQSTGSDSEVLTERTSCSFSTHTDLASGAAGPVPAAMSSMEEIQVELQCADLWKRFHDIGTEMIITKAGRRMFPAMRVKITGLDPHQQYYIAMDIVPVDNKRYRYVYHSSKWMVAGNADSPVPPRVYIHPDSLASGDTWMRQVVSFDKLKLTNNELDDQGHIILHSMHKYQPRVHVIRKDFSSDLSPTKPVPVGDGVKTFNFPETVFTTVTAYQNQQITRLKIDRNPFAKGFRDSGRNRTGLEAIMETYAFWRPPVRTLTFEDFTTMQKQQGGSTGTSPTTSSTGTPSPSASSHLLSPSCSPPTFHLAPNTFNVGCRESQLCNLNLSDYPPCARSNMAALQSYPGLSDSGYNRLQSGTTSATQPSETFMPQRTPSLISGIPTPPSLPGNSKMEAYGGQLGSFPTSQFQYVMQAGNAASSSSSPHMFGGSHMQQSSYNAFSLHNPYNLYGYNFPTSPRLAASPEKLSASQSTLLCSSPSNGAFGERQYLPSGMEHSMHMISPSPNNQQATNTCDGRQYGAVPGSSSQMSVHMV

SEQ ID NO: 15717 - protein, 607 aa, Homo Sapiens
MAEKRRGSPCSMLSLKAHAFSVEALIGAEKQQQLQKKRRKLGAEEAAGAVDDGGCSRGGGAGEKGSSEGDEGAALPPPAGATSGPARSGADLERGAAGGCEDGFQQGASPLASPGGSPKGSPARSLARPGTPLPSPQAPRVDLQGAELWKRFHEIGTEMIITKAGRRMFPAMRVKISGLDPHQQYYIAMDIVPVDNKRYRYVYHSSKWMVAGNADSPVPPRVYIHPDSPASGETWMRQVISFDKLKLTNNELDDQGHIILHSMHKYQPRVHVIRKDCGDDLSPIKPVPSGEGVKAFSFPETVFTTVTAYQNQQITRLKIDRNPFAKGFRDSGRNRMGLEALVESYAFWRPSLRTLTFEDIPGIPKQGNASSSTLLQGTGNGVPATHPHLLSGSSCSSPAFHLGPNTSQLCSLAPADYSACARSGLTLNRYSTSLAETYNRLTNQAGETFAPPRTPSYVGVSSSTSVNMSMGGTDGDTFSCPQTSLSMQISGMSPQLQYIMPSPSSNAFATNQTHQGSYNTFRLHSPCALYGYNFSTSPKLAASPEKIVSSQGSFLGSSPSGTMTDRQMLPPVEGVHLLSSGGQQSFFDSRTLGSLTLSSSQVSAHMV

SEQ ID NO: 15718 - protein, 448 aa, Homo Sapiens
MAMSELGTRKPSDGTVSHLLNVVESELQAGREKGDPTEKQLQIILEDAPLWQRFKEVTNEMIVTKNGRRMFPVLKISVTGLDPNAMYSLLLDFVPTDSHRWKYVNGEWVPAGKPEVSSHSCVYIHPDSPNFGAHWMKAPISFSKVKLTNKLNGGGQIMLNSLHKYEPQVHIVRVGSAHRMVTNCSFPETQFIAVTAYQNEEITALKIKYNPFAKAFLDAKERNHLRDVPEAISESQHVTYSHLGGWIFSNPDGVCTAGNSNYQYAAPLPLPAPHTHHGCEHYSGLRGHRQAPYPSAYMHRNHSPSVNLIESSSNNLQVFSGPDSWTSLSSTPHASILSVPHTNGPINPGPSPYPCLWTISNGAGGPSGPGPEVHASTPGAFLLGNPAVTSPPSVLSTQAPTSAGVEVLGEPSLTSIAVSTWTAVASHPFAGWGGPGAGGHHSPSSLDG

SEQ ID NO: 15719 - protein, 712 aa, Homo Sapiens
MREPALAASAMAYHPFHAPRPADFPMSAFLAAAQPSFFPALALPPGALAKPLPDPGLAGAAAAAAAAAAAAEAGLHVSALGPHPPAAHLRSLKSLEPEDEVEDDPKVTLEAKELWDQFHKLGTEMVITKSGRRMFPPFKVRVSGLDKKAKYILLMDIVAADDCRYKFHNSRWMVAGKADPEMPKRMYIHPDSPATGEQWMAKPVAFHKLKLTNNISDKHGFTILNSMHKYQPRFHIVRANDILKLPYSTFRTYVFPETDFIAVTAYQNDKITQLKIDNNPFAKGFRDTGNGRREKRKQLTLPSLRLYEEHCKPERDGAESDASSCDPPPAREPPTSPGAAPSPLRLHRARAEEKSCAADSDPEPERLSEERAGAPLGRSPAPDSASPTRLTEPERARERRSPERGKEPAESGGDGPFGLRSLEKERAEARRKDEGRKEAAEGKEQGLAPLVVQTDSASPLGAGHLPGLAFSSHLHGQQFFGPLGAGQPLFLHPGQFTMGPGAFSAMGMGHLLASVAGGGNGGGGGPGTAAGLDAGGLGPAASAASTAAPFPFHLSQHMLASQGIPMPTFGGLFPYPYTYMAAAAAAASALPATSAAAAAAAAAGSLSRSPFLGSARPRLRFSPYQIPVTIPPSTSLLTTGLASEGSKAAGGNSREPSPLPELALRKVGAPSRGALSPSGSAKEAANELQSIQRLVSGLESQRALSPGRESPK

SEQ ID NO: 15720 - protein, 447 aa, Homo Sapiens
MEFTASPKPQLSSRANAFSIAALMSSGGSKEKEATENTIKPLEQFVEKSSCAQPLGELTSLDAHGEFGGGSGSSPSSSSLCTEPLIPTTPIIPSEEMAKIACSLETKELWDKFHELGTEMIITKSGRRMFPTIRVSFSGVDPEAKYIVLMDIVPVDNKRYRYAYHRSSWLVAGKADPPLPARLYVHPDSPFTGEQLLKQMVSFEKVKLTNNELDQHGHIILNSMHKYQPRVHIIKKKDHTASLLNLKSEEFRTFIFPETVFTAVTAYQNQLITKLKIDSNPFAKGFRDSSRLTDIERESVESLIQKHSYARSPIRTYGGEEDVLGDESQTTPNRGSAFTTSDNLSLSSWVSSSSSFPGFQHPQSLTALGTSTASIATPIPHPIQGSLPPYSRLGMPLTPSAIASSMQGSGPTFPSFHMPRYHHYFQQGPYAAIQGLRHSSAVMTPFV

SEQ ID NO: 15721 - protein, 535 aa, Homo Sapiens; identical to SEQ ID NO: 15709

SEQ ID NO: 15722 - protein, 520 aa, Homo Sapiens
MALSSRARAFSVEALVGRPSKRKLQDPIQAEQPELREKKGGEEEEERRSSAAGKSEPLEKQPKTEPSTSASSGCGSDSGYGNSSESLEEKDIQMELQGSELWKRFHDIGTEMIITKAGRRMFPSVRVKVKGLDPGKQYHVAIDVVPVDSKRYRYVYHSSQWMVAGNTDHLCIIPRFYVHPDSPCSGETWMRQIISFDRMKLTNNEMDDKGHIILQSMHKYKPRVHVIEQGSSVDLSQIQSLPTEGVKTFSFKETEFTTVTAYQNQQITKLKIERNPFAKGFRDTGRNRGVLDGLLETYPWRPSFTLDFKTFGADTQSGSSGSSPVTSSGGAPSPLNSLLSPLCFSPMFHLPTSSLGMPCPEAYLPNVNLPLCYKICPTNFWQQQPLVLPAPERLASSNSSQSLAPLMMEVPMLSSLGVTNSKSGSSEDSSDQYLQAPNSTNQMLYGLQSPGNIFLPNSITPEALSCSFHPSYDFYRYNFSMPSRLISGSNHLKVNDDSQVSFGEGKCNHVHWYPAINHYL

SEQ ID NO: 15723 - protein, 743 aa, Homo Sapiens
MSLSMRDPVIPGTSMAYHPFLPHRAPDFAMSAVLGHQPPFFPALTLPPNGAAALSLPGALAKPIMDQLVGAAETGIPFSSLGPQAHLRPLKTMEPEEEVEDDPKVHLEAKELWDQFHKRGTEMVITKSGRRMFPPFKVRCSGLDKKAKYILLMDIIAADDCRYKFHNSRWMVAGKADPEMPKRMYIHPDSPATGEQWMSKVVTFHKLKLTNNISDKHGFTLAFPSDHATWQGNYSFGTQTILNSMHKYQPRFHIVRANDILKLPYSTFRTYLFPETEFIAVTAYQNDKITQLKIDNNPFAKGFRDTGNGRREKRKQLTLQSMRVFDERHKKENGTSDESSSEQAAFNCFAQASSPAASTVGTSNLKDLCPSEGESDAEAESKEEHGPEACDAAKISTTTSEEPCRDKGSPAVKAHLFAAERPRDSGRLDKASPDSRHSPATISSSTRGLGAEERRSPVREGTAPAKVEEARALPGKEAFAPLTVQTDAAAAHLAQGPLPGLGFAPGLAGQQFFNGHPLFLHPSQFAMGGAFSSMAAAGMGPLLATVSGASTGVSGLDSTAMASAAAAQGLSGASAATLPFHLQQHVLASQGLAMSPFGSLFPYPYTYMAAAAAASSAAASSSVHRHPFLNLNTMRPRLRYSPYSIPVPVPDGSSLLTTALPSMAAAAGPLDGKVAALAASPASVAVDSGSELNSRSSTLSSSSMSLSPKLCAEKEAATSELQSIQRLVSGLEAKPDRSRSASP

SEQ ID NO: 15724 - protein, 545 aa, Homo Sapiens
MLQDKGLSESEEAFRAPGPALGEASAANAPEPALAAPGLSGAALGSPPGPGADVVAAAAAEQTIENIKVGLHEKELWKKFHEAGTEMIITKAGRRMFPSYKVKVTGMNPKTKYILLIDIVPADDHRYKFCDNKWMVAGKAEPAMPGRLYVHPDSPATGAHWMRQLVSFQKLKLTNNHLDPFGHIILNSMHKYQPRLHIVKADENNAFGSKNTAFCTHVFPETSFISVTSYQNHKITQLKIENNPFAKGFRGSDDSDLRVARLQSKEYPVISKSIMRQRLISPQLSATPDVGPLLGTHQALQHYQHENGAHSQLAEPQDLPLSTFPTQRDSSLFYHCLKRRDGTRHLDLPCKRSYLEAPSSVGEDHYFRSPPPYDQQMLSPSYCSEVTPREACMYSGSGPEIAGVSGVDDLPPPPLSCNMWTSVSPYTSYSVQTMETVPYQPFPTHFTATTMMPRLPTLSAQSSQPPGNAHFSVYNQLSQSQVRERGPSASFPRERGLPQGCERKPPSPHLNAANEFLYSQTFSLSRESSLQYHSGMGTVENWTDG

SEQ ID NO: 15725 - protein, 518 aa, Homo Sapiens
MADADEGFGLAHTPLEPDAKDLPCDSKPESALGAPSKSPSSPQAAFTQQGMEGIKVFLHERELWLKFHEVGTEMIITKAGRRMFPSYKVKVTGLNPKTKYILLMDIVPADDHRYKFADNKWSVTGKAEPAMPGRLYVHPDSPATGAHWMRQLVSFQKLKLTNNHLDPFGHIILNSMHKYQPRLHIVKADENNGFGSKNTAFCTHVFPETAFIAVTSYQNHKITQLKIENNPFAKGFRGSDDMELHRMSRMQSKEYPVVPRSTVRQKVASNHSPFSSESRALSTSSNLGSQYQCENGVSGPSQDLLPPPNPYPLPQEHSQIYHCTKRKEEECSTTDHPYKKPYMETSPSEEDSFYRSSYPQQQGLGASYRTESAQRQACMYASSAPPSEPVPSLEDISCNTWPSMPSYSSCTVTTVQPMDRLPYQHFSAHFTSGPLVPRLAGMANHGSPQLGEGMFQHQTSVAHQPVVRQCGPQTGLQSPGTLQPPEFLYSHGVPRTLSPHQYHSVHGVGMVPEWSDNS

SEQ ID NO: 15726 - protein, 436 aa, Homo Sapiens
MYHPRELYPSLGAGYRLGPAQPGADSSFPPALAEGYRYPELDTPKLDCFLSGMEAAPRTLAAHPPLPLLPPAMGTEPAPSAPEALHSLPGVSLSLENRELWKEFSSVGTEMIITKAGRRMFPACRVSVTGLDPEARYLFLLDVIPVDGARYRWQGRRWEPSGKAEPRLPDRVYIHPDSPATGAHWMRQPVSFHRVKLTNSTLDPHGHLILHSMHKYQPRIHLVRAAQLCSQHWGGMASFRFPETTFISVTAYQNPQITQLKIAANPFAKGFRENGRNCKRERDARVKRKLRGPEPAATEAYGSGDTPGGPCDSTLGGDIRESDPEQAPAPGEATAAPAPLCGGPSAEAYLLHPAAFHGAPSHLPTRSPSFPEAPDSGRSAPYSAAFLELPHGSGGSGYPAAPPAVPFAPHFLQGGPFPLPYTAPGGYLDVGSKPMY

SEQ ID NO: 15727 - protein, 682 aa, Homo Sapiens; identical to SEQ ID NO: 13041

SEQ ID NO: 15728 - protein, 199 aa, Homo Sapiens
MAFALLRPVGAHVLYPDVRLLSEDEENRSESDASDQSFGCCEGPEAARRGPGPGGGRRAGGGGGAGPVVVVRQRQAANARERDRTQSVNTAFTALRTLIPTEPVDRKLSKIETVRLASSYIAHLANVLLLGDSADDGQPCFRAAGSAKGAVPAAADGGRQPRSICTFCLSNQRKGGGRRDLGGSCLKVRGVAPLRGPRR

SEQ ID NO: 15729 - protein, 345 aa, Homo Sapiens
MLPCFQLLRIGGGRGGDLYTFHPPAGAGCTYRLGHRADLCDVALRPQQEPGLISGIHAELHAEPRGDDWRVSLEDHSSQGTLVNNVRLPRGHRLELSDGDLLTFGPEGPPGTSPSEFYFMFQQVRVKPQDFAAITIPRSRGEARVGAGFRPMLPSQGAPQRPLSTFSPAPKATLILNSIGSLSKLRPQPLTFSPSWGGPKSLPVPAPPGEMGTTPSAPPQRNRRKSVHRVLAELDDESEPPENPPPVLMEPRKKLRVDKAPLTPTGNRRGRPRKYPVSAPMAPPAVGGGEPCAAPCCCLPQEETVAWVQCDGCDVWFHVACVGCSIQAAREADFRCPGCRAGIQT

SEQ ID NO: 15730 - protein, 1960 aa, Homo Sapiens [sequence omitted]

SEQ ID NO: 15731 - protein, 179 aa, Homo Sapiens
MSTGSLSDVEDLQEVEMLECDGLKMDSNKEFVTSNESTEESSNCENGSPQKGRGGLGKRRKAPTKKSPLSGVSQEGKQVQRNAANARERARMRVLSKAFSRLKTTLPWVPPDTKLSKLDTLRLASSYIAHLRQILANDKYENGYIHPVNLTWPFMVAGKPESDLKEVVTASRLCGTTAS

SEQ ID NO: 15732 - protein, 214 aa, Homo Sapiens
MSQRKARGPPAMPGVGHSQTQAKARLLPGADRKRSRLSRTRQDPWEERSWSNQRWSRATPGPRGTRAGGLALGRSEASPENAARERSRVRTLRQAFLALQAALPAVPPDTKLSKLDVLVLAASYIAHLTRTLGHELPGPAWPPFLRGLRYLHPLKKWPMRSRLYAGGLGYSDLDSTTASTPSQRTRDAEVGSQVPGEADALLSTTPLSPALGDK

SEQ ID NO: 15733 - protein, 167 aa, Homo Sapiens
MDRGRPAGSPLSASAEPAPLAAAIRDSRPGRTGPGPAGPGGGSRSGSGRPAAANAARERSRVQTLRHAFLELQRTLPSVPPDTKLSKLDVLLLATTYIAHLTRSLQDDAEAPADAGLGALRGDGYLHPVKKWPMRSRLYIGATGQFLKHSVSGEKTNHDNTPTDSQP

SEQ ID NO: 15734 - protein, 676 aa, Homo Sapiens
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEEYQQAQHKFLVAVESMEPNNIVVLLQTSPYHVDSLLQLSDACRFQEDQEMARDLVERALYSMECAFHPLFSLTSGACRLDYRRPENRSFYLALYKQMSFLEKRGCPRTALEYCKLILSLEPDEDPLCMLLLIDHLALRARNYEYLIRLFQEWEAHRNLSQLPNFAFSVPLAYFLLSQQTDLPECEQSSARQKASLLIQQALTMFPGVLLPLLESCSVRPDASVSSHRFFGPNAEISQPPALSQLVNLYLGRSHFLWKEPATMSWLEENVHEVLQAVDAGDPAVEACENRRKVLYQRAPRNIHRHVILSEIKEAVAALPPDVTTQSVMGFDPLPPSDTIYSYVRPERLSPISHGNTIALFFRSLLPNYTMEGERPEEGVAGGLNRNQGLNRLMLAVRDMMANFHLNDLEAPHEDDAEGEGEWD

SEQ ID NO: 15735 - protein, 654 aa, Homo Sapiens
MNQPQRMAPVGTDKELSDLLDFSMMFPLPVTNGKGRPASLAGAQFGGSGLEDRPSSGSWGSGDQSSSSFDPSRTFSEGTHFTESHSSLSSSTFLGPGLGGKSGERGAYASFGRDAGVGGLTQAGFLSGELALNSPGPLSPSGMKGTSQYYPSYSGSSRRRAADGSLDTQPKKVRKVPPGLPSSVYPPSSGEDYGRDATAYPSAKTPSSTYPAPFYVADGSLHPSAELWSPPGQAGFGPMLGGGSSPLPLPPGSGPVGSSGSSSTFGGLHQHERMGYQLHGAEVNGGLPSASSFSSAPGATYGGVSSHTPPVSGADSLLGSRGTTAGSSGDALGKALASIYSPDHSSNNFSSSPSTPVGSPQGLAGTSQWPRAGAPGALSPSYDGGLHGLQSKIEDHLDEAIHVLRSHAVGTAGDMHTLLPGHGALASGFTGPMSLGGRHAGLVGGSHPEDGLAGSTSLMHNHAALPSQPGTLPDLSRPPDSYSGLGRAGATAAASEIKREEKEDEENTSAADHSEEEKKELKAPRARTSPDEDEDDLLPPEQKAEREKERRVANNARERLRVRDINEAFKELGRMCQLHLNSEKPQTKLLILHQAVSVILNLEQQVRERNLNPKAACLKRREEEKVSGVVGDPQMVLSAPHPGLSEAHNPAGHM

SEQ ID NO: 15736 - protein, 667 aa, Homo Sapiens
MHHQQRMAALGTDKELSDLLDFSAMFSPPVSSGKNGPTSLASGHFTGSNVEDRSSSGSWGNGGHPSPSRNYGDGTPYDHMTSRDLGSHDNLSPPFVNSRIQSKTERGSYSSYGRESNLQGCHQQSLLGGDMDMGNPGTLSPTKPGSQYYQYSSNNPRRRPLHSSAMEVQTKKVRKVPPGLPSSVYAPSASTADYNRDSPGYPSSKPATSTFPSSFFMQDGHHSSDPWSSSSGMNQPGYAGMLGNSSHIPQSSSYCSLHPHERLSYPSHSSADINSSLPPMSTFHRSGTNHYSTSSCTPPANGTDSIMANRGSGAAGSSQTGDALGKALASIYSPDHTNNSFSSNPSTPVGSPPSLSAGTAVWSRNGGQASSSPNYEGPLHSLQSRIEDRLERLDDAIHVLRNHAVGPSTAMPGGHGDMHGIIGPSHNGAMGGLGSGYGTGLLSANRHSLMVGTHREDGVALRGSHSLLPNQVPVPQLPVQSATSPDLNPPQDPYRGMPPGLQGQSVSSGSSEIKSDDEGDENLQDTKSSEDKKLDDDKKDIKSITSNNDDEDLTPEQKAEREKERRMANNARERLRVRDINEAFKELGRMVQLHLKSDKPQTKLLILHQAVAVILSLEQQVRERNLNPKAACLKRREEEKVSSEPPPLSLAGPHPGMGDASNHMGQM

SEQ ID NO: 15737 - protein, 384 aa, Homo Sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTETNWPRELKDGNGQESLSMSSSSSPA

SEQ ID NO: 15738 - protein, 588 aa, Homo Sapiens
MPQLGGGGGGGGGGSGGGGGSSAGAAGGGDDLGANDELIPFQDEGGEEQEPSSDSASAQRDLDEVKSSLVNESENQSSSSDSEAERRPQPVRDTFQKPRDYFAEVRRPQDSAFFKGPPYPGYPFLMIPDLSSPYLSNGPLSPGGARTYLQMKWPLLDVPSSATVKDTRSPSPAHLSNKVPVVQHPHHMHPLTPLITYSNDHFSPGSPPTHLSPEIDPKTGIPRPPHPSELSPYYPLSPGAVGQIPHPLGWLVPQQGQPMYSLPPGGFRHPYPALAMNASMSSLVSSRFSPHMVAPAHPGLPTSGIPHPAIVSPIVKQEPAPPSLSPAVSVKSPVTVKKEEEKKPHVKKPLNAFMLYMKEMRAKVVAECTLKESAAINQILGRKWHNLSREEQAKYYELARKERQLHSQLYPTWSARDNYGKKKKRKREKQLSQTQSQQQVQEAEGALASKSKKPCVQYLPPEKPCDSPASSHGSMLDSPATPSAALASPAAPAATHSEQAQPLSLTTKPETRAQLALHSAAFLSAKAAASSSGQMGSQPPLLSRPLPLGSMPTALLASPPSFPATLHAHQALPVLQAQPLSLVTKSAH

SEQ ID NO: 15739 - protein, 619 aa, Homo Sapiens
MPQLNGGGGDDLGANDELISFKDEGEQEEKSSENSSAERDLADVKSSLVNESETNQNSSSDSEAERRPPPRSESFRDKSRESLEEAAKRQDGGLFKGPPYPGYPFIMIPDLTSPYLPNGSLSPTARTLHFQSGSTHYSAYKTIEHQIAVQYLQMKWPLLDVQAGSLQSRQALKDARSPSPAHIVSNKVPVVQHPHHVHPLTPLITYSNEHFTPGNPPPHLPADVDPKTGIPRPPHPPDISPYYPLSPGTVGQIPHPLGWLVPQQGQPVYPITTGGFRHPYPTALTVNASMSRFPPHMVPPHHTLHTTGIPHPAIVTPTVKQESSQSDVGSLHSSKHQDSKKEEEKKKPHIKKPLNAFMLYMKEMRAKVVAECTLKESAAINQILGRRWHALSREEQAKYYELARKERQLHMQLYPGWSARDNYGKKKKRKRDKQPGETNEHSECFLNPCLSLPPITDLSAPKKCRARFGLDQQNNWCGPCRRKKKCVRYIQGEGSCLSPPSSDGSLLDSPPPSPNLLGSPPRDAKSQTEQTQPLSLSLKPDPLAHLSMMPPPPALLLAEATHKASALCPNGALDLPPAALQPAAPSSSIAQPSTSSLHSHSSLAGTQPQPLSLVTKSLE

SEQ ID NO: 15740 - protein, 500 aa, Homo Sapiens
MSGPGPREPPPEAGAAGGEAAVEGAGGGDAALGEPGLSFTTTDLSLVEMTEVEYTQLQHILCSHMEAAADGELETRLNSALLAAAGPGAGAGGFAAGGQGGAAPVYPVLCPSALAADAPCLGHIDFQELRMMLLSEAGAAEKTSGGGDGARARADGAAKEGAGAAAAAAGPDGAPEARAKPAVRVRLEDRFNSIPAEPPPAPRGPEPPEPGGALNNLVTLIRHPSELMNVPLQQQNKCTALVKNKTAATTTALQFTYPLFTTNACSTSGNSNLSQTQSSSNSCSVLEAAKHQDIGLPRAFSFCYQQEIESTKQTLGSRNKVLPEQVWIKVGEAALCKQALKRNRSRMRQLDTNVERRALGEIQNVGEGATATQGAWQSSESSQANLGEQAQSGPQGGRSQRRERHNRMERDRRRRIRICCDELNLLVPFCNAETDKATTLQWTTAFLKYIQERHGDSLKKEFESVFCGKTGRRLKLTRPDSLVTCPAQGSLQSSPSMEIK

SEQ ID NO: 15741 - protein, 426 aa, Homo Sapiens
MEPSSWSGSESPAENMERMSDSADKPIDNDAEGVWSPDIEQSFQEALAIYPPCGRRKIILSDEGKMYGRNELIARYIKLRTGKTRTRKQVSSHIQVLARRKSRDFHSKLKDQTAKDKALQHMAAMSSAQIVSATAIHNKLGLPGIPRPTFPGAPGFWPGMIQTGQPGSSQDVKPFVQQAYPIQPAVTAPIPGFEPASAPAPSVPAWQGRSIGTTKLRLVEFSAFLEQQRDPDSYNKHLFVHIGHANHSYSDPLLESVDIRQIYDKFPEKKGGLKELFGKGPQNAFFLVKFWADLNCNIQDDAGAFYGVTSQYESSENMTVTCSTKVCSFGKQVVEKVETEYARFENGRFVYRINRSPMCEYMINFIHKLKHLPEKYMMNSVLENFTILLVVTNRDTQETLLCMACVFEVSNSEHGAQHHIYRLVKD

SEQ ID NO: 15742 - protein, 447 aa, Homo Sapiens
MGEPRAGAALDDGSGWTGSEEGSEEGTGGSEGAGGDGGPDAEGVWSPDIEQSFQEALAIYPPCGRRKIILSDEGKMYGRNELIARYIKLRTGKTRTRKQVSSHIQVLARRKSREIQSKLKDQVSKDKAFQTMATMSSAQLISAPSLQAKLGPTGPQASELFQFWSGGSGPPWNVPDVKPFSQTPFTLSLTPPSTDLPGYEPPQALSPLPPPTPSPPAWQARGLGTARLQLVEFSAFVEPPDAVDSYQRHLFVHISQHCPSPGAPPLESVDVRQIYDKFPEKKGGLRELYDRGPPHAFFLVKFWADLNWGPSGEEAGAGGSISSGGFYGVSSQYESLEHMTLTCSSKVCSFGKQVVEKVETERAQLEDGRFVYRLLRSPMCEYLVNFLHKLRQLPERYMMNSVLENFTILQVVTNRDTQELLLCTAYVFEVSTSERGAQHHIYRLVRD

SEQ ID NO: 15743 - protein, 435 aa, Homo Sapiens
MASNSWNASSSPGEAREDGPEGLDKGLDNDAEGVWSPDIEQSFQEALAIYPPCGRRKIILSDEGKMYGRNELIARYIKLRTGKTRTRKQVSSHIQVLARKKVREYQVGIKAMNLDQVSKDKALQSMASMSSAQIVSASVLQNKFSPPSPLPQAVFSTSSRFWSSPPLLGQQPGPSQDIKPFAQPAYPIQPPLPPTLSSYEPLAPLPSAAASVPVWQDRTIASSRLRLLEYSAFMEVQRDPDTYSKHLFVHIGQTNPAFSDPPLEAVDVRQIYDKFPEKKGGLKELYEKGPPNAFFLVKFWADLNSTIQEGPGAFYGVSSQYSSADSMTISVSTKVCSFGKQVVEKVETEYARLENGRFVYRIHRSPMCEYMINFIHKLKHLPEKYMMNSVLENFTILQVVTSRDSQETLLVIAFVFEVSTSEHGAQHHVYKLVKD

SEQ ID NO: 15744 - protein, 434 aa, Homo Sapiens
MEGTAGTITSNEWSSPTSPEGSTASGGSQALDKPIDNDAEGVWSPDIEQSFQEALAIYPPCGRRKIILSDEGKMYGRNELIARYIKLRTGKTRTRKQVSSHIQVLARRKAREIQAKLKDQAAKDKALQSMAAMSSAQIISATAFHSSMALARGPGRPAVSGFWQGALPGQAGTSHDVKPFSQQTYAVQPPLPLPGFESPAGPAPSPSAPPAPPWQGRSVASSKLWMLEFSAFLEQQQDPDTYNKHLFVHIGQSSPSYSDPYLEAVDIRQIYDKFPEKKGGLKDLFERGPSNAFFLVKFWADLNTNIEDEGSSFYGVSSQYESPENMIITCSTKVCSFGKQVVEKVETEYARYENGHYSYRIHRSPLCEYMINFIHKLKHLPEKYMMNSVLENFTILQVVTNRDTQETLLCIAYVFEVSASEHGAQHHIYRLVKE

SEQ ID NO: 15745 - protein, 303 aa, Homo Sapiens
MSDAGGGKKPPVDPQAGPGPGPGRAAGERGLSGSFPLVLKKLMENPPREARLDKEKGKEKLEEDEAAAASTMAVSASLMPPIWDKTIPYDGESFHLEYMDLDEFLLENGIPASPTHLAHNLLLPVAELEGKESASSSTASPPSSSTAIFQPSETVSSTESSLEKERETPSPIDPNCVEVDVNFNPDPADLVLSSVPGGELFNPRKHKFAEEDLKPQPMIKKAKKVFVPDEQKDEKYWTRRKKNNVAAKRSRDARRLKENQITIRAAFLEKENTALRTEVAELRKEVGKCKTIVSKYETKYGPL

SEQ ID NO: 15746 - protein, 439 aa, Homo Sapiens
MAEDVSSAAPSPRGCADGRDADPTEEQMAETERNDEEQFECQELLECQVQVGAPEEEEEEEEDAGLVAEAEAVAAGWMLDFLCLSLCRAFRDGRSEDFRRTRNSAEAIIHGLSSLTACQLRTIYICQFLTRIAAGKTLDAQFENDERITPLESALMIWGSIEKEHDKLHEEIQNLIKIQAIAVCMENGNFKEAEEVFERIFGDPNSHMPFKSKLLMIISQKDTFHSFFQHFSYNHMMEKIKSYVNYVLSEKSSTFLMKAAAKVVESKRTRTITSQDKPSGNDVEMETEANLDTRKSVSDKQSAVTESSEGTVSLLRSHKNLFLSKLQHGTQQQDLNKKERRVGTPQSTKKKKESRRATESRIPVSKSQPVTPEKHRARKRQAWLWEEDKNLRSGVRKYGEGNWSKILLHYKFNNRTSVMLKDRWRTMKKLKLISSDSED

SEQ ID NO: 15747 - protein, 542 aa, Homo Sapiens
MAAGAGTAGPASGPGVVRDPAASQPRKRPGREGGEGARRSDTMAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFSYETFQQKMLRFLESHLDDAEPYLLTMAKKALKSESAASSTGKEDKQPAPGPVEKPPREPARQLRNPPTTIGMMTLKAAFKTLSGAQDSEAAFAKLDQKDLVLPTQALPASPALKNKRPRKDENESSAPADGEGGSELQPKNKRMTISRLVLEEDSQSTEPSAGLNSSQEAASAPPSKPTVLNQPLPGEKNPKVPKGKWNSSNGVEEKETWVEEDELFQVQAAPDEDSTTNITKKQKWTVEESEWVKAGVQKYGEGNWAAISKNYPFVNRTAVMIKDRWRTMKRLGMN

SEQ ID NO: 15748 - protein, 2136 aa, Homo Sapiens
MSRSRHARPSRLVRKEDVNKKKKNSQLRKTTKGANKNVASVKTLSPGKLKQLIQERDVKKKTEPKPPVPVRSLLTRAGAARMNLDRTEVLFQNPESLTCNGFTMALRSTSLSRRLSQPPLVVAKSKKVPLSKGLEKQHDCDYKILPALGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGIAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVVVPLEVIKENKRPQREKKPKVLKADFDNKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTVRNGIKHVHCLPAETNVSFKKFNIEEFGKTLENNSYKFLKDTANHKNAMSSVATDMSCDHLKGRSNVLVFQQPGFNCSSIPHSSHSIINHHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVESTPTSLVTCNVQQKYNQEKGTIQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHQRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 15749 - protein, 2002 aa, Homo Sapiens
MEQDRTNHVEGNRLSPFLIPSPPICQTEPLATKLQNGSPLPERAHPEVNGDTKWHSFKSYYGIPCMKGSQNSRVSPDFTQESRGYSKCLQNGGIKRTVSEPSLSGLLQIKKLKQDQKANGERRNFGVSQERNPGESSQPNVSDLSDKKESVSSVAQENAVKDFTSFSTHNCSGPENPELQILNEQEGKSANYHDKNIVLLKNKAVLMPNGATVSASSVEHTHGELLEKTLSQYYPDCVSIAVQKTTSHINAINSQATNELSCEITHPSHTSGQINSAQTSNSELPPKPAAVVSEACDADDADNASKLAAMLNTCSFQKPEQLQQQKSVFEICPSPAENNIQGTTKLASGEEFCSGSSSNLQAPGGSSERYLKQNEMNGAYFKQSSVFTKDSFSATTTPPPPSQLLLSPPPPLPQVPQLPSEGKSTLNGGVLEEHHHYPNQSNTTLLREVKIEGKPEAPPSQSPNPSTHVCSPSPMLSERPQNNCVNRNDIQTAGTMTVPLCSEKTRPMSEHLKHNPPIFGSSGELQDNCQQLMRNKEQEILKGRDKEQTRDLVPPTQHYLKPGWIELKAPRFHQAESHLKRNEASLPSILQYQPNLSNQMTSKQYTGNSNMPGGLPRQAYTQKTTQLEHKSQMYQVEMNQGQSQGTVDQHLQFQKPSHQVHFSKTDHLPKAHVQSLCGTRFHFQQRADSQTEKLMSPVLKQHLNQQASETEPFSNSHLLQHKPHKQAAQTQPSQSSHLPQNQQQQQKLQIKNKEEILQTFPHPQSNNDQQREGSFFGQTKVEECFHGENQYSKSSEFETHNVQMGLEEVQNINRRNSPYSQTMKSSACKIQVSCSNNTHLVSENKEQTTHPELFAGNKTQNLHHMQYFPNNVIPKQDLLHRCFQEQEQKSQQASVLQGYKNRNQDMSGQQAAQLAQQRYLIHNHANVFPVPDQGGSHTQTPPQKDTQKHAALRWHLLQKQEQQQTQQPQTESCHSQMHRPIKVEPGCKPHACMHTAPPENKTWKKVTKQENPPASCDNVQQKSIIETMEQHLKQFHAKSLFDHKALTLKSQKQVKVEMSGPVTVLTRQTTAAELDSHTPALEQQTTSSEKTPTKRTAASVLNNFIESPSKLLDTPIKNLLDTPVKTQYDFPSCRCVEQIIEKDEGPFYTHLGAGPNVAAIREIMEERFGQKGKAIRIERVIYTGKEGKSSQGCPIAKWVVRRSSSEEKLLCLVRERAGHTCEAAVIVILILVWEGIPLSLADKLYSELTETLRKYGTLTNRRCALNEERTCACQGLDPETCGASFSFGCSWSMYYNGCKFARSKIPRKFKLLGDDPKEEEKLESHLQNLSTLMAPTYKKLAPDAYNNQIEYEHRAPECRLGLKEGRPFSGVTACLDFCAHAHRDLHNMQNGSTLVCTLTREDNREFGGKPEDEQLHVLPLYKVSDVDEFGSVEAQEEKKRSGAIQVLSSFRRKVRMLAEPVKTCRQRKLEAKKAAAEKLSSLENSSNKNEKEKSAPSRTKQTENASQAKQLAELLRLSGPVMQQSQQPQPLQKQPPQPQQQQRPQQQQPHHPQTESVNSYSASGSTNPYMRRPNPVSPYPNSSHTSDIYGSTSPMNFYSTSSQAAGSYLNSSNPMNPYPGLLNQNTQYPSYQCNGNLSVDNCSPYLGSYSPQSQPMDLYRYPSQDPLSKLSLPPIHTLYQPRFGNSQSFTSKYLGYGNQNMQGDGFSSCTIRPNVHHVGKLPPYPTHEMDGHFMGATSRLPPNLSNPNMDYKNGEHHSPSHIIHNYSAAPGMFNSSLHALHLQNKENDMLSHTANGLSKMLPALNHDRTACVQGGLHKLSDANGQEKQPLALVQGVASGAEDNDEVWSDSEQSFLDPDIGGVAVAPTHGSILIECAKRELHATTPLKNPNRNHPTRISLVFYQHKSMNEPKHGLALWEAKMAEKAREKEEECEKYGPDYVPQKSHGKKVKREPAEPHETSEPTYLRFIKSLAERTMSVTTDSTVTTSPYAFTRVTGPYNRYI

SEQ ID NO: 15750 - protein, 1660 aa, Homo Sapiens
MDSGPVYHGDSRQLSASGVPVNGAREPAGPSLLGTGGPWRVDQKPDWEAAPGPAHTARLEDAHDLVAFSAVAEAVSSYGALSTRLYETFNREMSREAGNNSRGPRPGPEGCSAGSEDLDTLQTALALARHGMKPPNCNCDGPECPDYLEWLEGKIKSVVMEGGEERPRLPGPLPPGEAGLPAPSTRPLLSSEVPQISPQEGLPLSQSALSIAKEKNISLQTAIAIEALTQLSSALPQPSHSTPQASCPLPEALSPPAPFRSPQSYLRAPSWPVVPPEEHSSFAPDSSAFPPATPRTEFPEAWGTDTPPATPRSSWPMPRPSPDPMAELEQLLGSASDYIQSVFKRPEALPTKPKVKVEAPSSSPAPAPSPVLQREAPTPSSEPDTHQKAQTALQQHLHHKRSLFLEQVHDTSFPAPSEPSAPGWWPPPSSPVPRLPDRPPKEKKKKLPTPAGGPVGTEKAAPGIKPSVRKPIQIKKSRPREAQPLFPPVRQIVLEGLRSPASQEVQAHPPAPLPASQGSAVPLPPEPSLALFAPSPSRDSLLPPTQEMRSPSPMTALQPGSTGPLPPADDKLEELIRQFEAEFGDSFGLPGPPSVPIQDPENQQTCLPAPESPFATRSPKQIKIESSGAVTVLSTTCFHSEEGGQEATPTKAENPLTPTLSGFLESPLKYLDTPTKSLLDTPAKRAQAEFPTCDCVEQIVEKDEGPYYTHLGSGPTVASIRELMEERYGEKGKAIRIEKVIYTGKEGKSSRGCPIAKWVIRRHTLEEKLLCLVRHRAGHHCQNAVIVILILAWEGIPRSLGDTLYQELTDTLRKYGNPTSRRCGLNDDRTCACQGKDPNTCGASFSFGCSWSMYFNGCKYARSKTPRKFRLAGDNPKEEEVLRKSFQDLATEVAPLYKRLAPQAYQNQVTNEEIAIDCRLGLKEGRPFAGVTACMDFCAHAHKDQHNLYNGCTVVCTLTKEDNRCVGKIPEDEQLHVLPLYKMANTDEFGSEENQNAKVGSGAIQVLTAFPREVRRLPEPAKSCRQRQLEARKAAAEKKKIQKEKLSTPEKIKQEALELAGITSDPGLSLKGGLSQQGLKPSLKVEPQNHFSSFKYSGNAVVESYSVLGNCRPSDPYSMNSVYSYHSYYAQPSLTSVNGFHSKYALPSFSYYGFPSSNPVFPSQFLGPGAWGHSGSSGSFEKKPDLHALHNSLSPAYGGAEFAELPSQAVPTDAHHPTPHHQQPAYPGPKEYLLPKAPLLHSVSRDPSPFAQSSNCYNRSIKQEPVDPLTQAEPVPRDAGKMGKTPLSEVSQNGGPSHLWGQYSGGPSMSPKRTNGVGGSWGVFSSGESPAIVPDKLSSFGASCLAPSHFTDGQWGLFPGEGQQAASHSGGRLRGKPWSPCKFGNSTSALAGPSLTEKPWALGAGDFNSALKGSPGFQDKLWNPMKGEEGRIPAAGASQLDRAWQSFGLPLGSSEKLFGALKSEEKLWDPFSLEEGPAEEPPSKGAVKEEKGGGGAEEEEEELWSDSEHNFLDENIGGVAVAPAHGSILIECARRELHATTPLKKPNRCHPTRISLVFYQHKNLNQPNHGLALWEAKMKQLAERARARQEEAARLGLGQQEAKLYGKKRKWGGTVVAEPQQKEKKGVVPTRQALAVPTDSAVTVSSYAYTKVTGPYSRWI

SEQ ID NO: 15751 - protein, 246 aa, Homo Sapiens; identical to SEQ ID NO: 13129

SEQ ID NO: 15752 - protein, 437 aa, Homo Sapiens
MLWKLTDNIKYEDCEDRHDGTSNGTARLPQLGTVGQSPYTSAPPLSHTPNADFQPPYFPPPYQPIYPQSQDPYSHVNDPYSLNPLHAQPQPQHPGWPGQRQSQESGLLHTHRGLPHQLSGLDPRRDYRRHEDLLHGPHALSSGLGDLSIHSLPHAIEEVPHVEDPGINIPDQTVIKKGPVSLSKSNSNAVSAIPINKDNLFGGVVNPNEVFCSVPGRLSLLSSTSKYKVTVAEVQRRLSPPECLNASLLGGVLRRAKSKNGGRSLREKLDKIGLNLPAGRRKAANVTLLTSLVEGEAVHLARDFGYVCETEFPAKAVAEFLNRQHSDPNEQVTRKNMLLATKQICKEFTDLLAQDRSPLGNSRPNPILEPGIQSCLTHFNLISHGFGSPAVCAAVTALQNYLTEALKAMDKMYLSNNPNSHTDNNAKSSDKEEKHRK

SEQ ID NO: 15753 - protein, 460 aa, Homo Sapiens
MHSPPRDQAAIMLWKLVENVKYEDIYEDRHDGVPSHSSRLSQLGSVSQGPYSSAPPLSHTPSSDFQPPYFPPPYQPLPYHQSQDPYSHVNDPYSLNPLHQPQQHPWGQRQRQEVGSEAGSLLPQPRAALPQLSGLDPRRDYHSVRRPDVLLHSAHHGLDAGMGDSLSLHGLGHPGMEDVQSVEDANNSGMNLLDQSVIKKVPVPPKSVTSLMMNKDGFLGGMSVNTGEVFCSVPGRLSLLSSTSKYKVTVGEVQRRLSPPECLNASLLGGVLRRAKSKNGGRSLRERLEKIGLNLPAGRRKAANVTLLTSLVEGEAVHLARDFGYICETEFPAKAVSEYLNRQHTDPSDLHSRKNMLLATKQLCKEFTDLLAQDRTPIGNSRPSPILEPGIQSCLTHFSLITHGFGAPAICAALTALQNYLTEALKGMDKMFLNNTTTNRHTSGEGPGSKTGDKEEKHRK

SEQ ID NO: 15754 - protein, 450 aa, Homo Sapiens
MLWKITDNVKYEEDCEDRHDGSSNGNPRVPHLSSAGQHLYSPAPPLSHTGVAEYQPPPYFPPPYQQLAYSQSADPYSHLGEAYAAAINPLHQPAPTGSQQQAWPGRQSQEGAGLPSHHGRPAGLLPHLSGLEAGAVSARRDAYRRSDLLLPHAHALDAAGLAENLGLHDMPHQMDEVQNVDDQHLLLHDQTVIRKGPISMTKNPLNLPCQKELVGAVMNPTEVFCSVPGRLSLLSSTSKYKVTVAEVQRRLSPPECLNASLLGGVLRRAKSKNGGRSLREKLDKIGLNLPAGRRKAAHVTLLTSLVEGEAVHLARDFAYVCEAEFPSKPVAEYLTRPHLGGRNEMAARKNMLLAAQQLCKEFTELLSQDRTPHGTSRLAPVLETNIQNCLSHFSLITHGFGSQAICAAVSALQNYIKEALIVIDKSYMNPGDQSPADSNKTLEKMEKHRK

SEQ ID NO: 15755 - protein, 452 aa, Homo Sapiens
MSTTFPGLVHDAEIRHDGSNSYRLMQLGCLESVANSTVAYSSSSPLTYSTTGTEFASPYFSTNHQYTPLHHQSFHYEFQHSHPAVTPDAYSLNSLHHSQQYYQQIHHGEPTDFINLHNARALKSSCLDEQRRELGCLDAYRRHDLSLMSHGSQYGMHPDQRLLPGPSLGLAAAGADDLQGSVEAQCGLVLNGQGGVIRRGGTCVVNPTDLFCSVPGRLSLLSSTSKYKVTIAEVKRRLSPPECLNASLLGGILRRAKSKNGGRCLREKLDRLGLNLPAGRRKAANVTLLTSLVEGEALHLARDFGYTCETEFPAKAVGEHLARQHMEQKEQTARKKMILATKQICKEFQDLLSQDRSPLGSSRPTPILDLDIQRHLTHFSLITHGFGTPAICAALSTFQTVLSEMLNYLEKHTTHKNGGAADSGQGHANSEKAPLRKTSEAAVKEGKTEKTD

SEQ ID NO: 15756 - protein, 442 aa, Homo Sapiens
MLVHTYSAMERPDGLGAAAGGARLSSLPQAAYGPAPPLCHTPAATAAAEFQPPYFPPPYPQPPLPYGQAPDAAAAFPHLAGDPYGGLAPLAQPQPPQAAWAAPRAAARAHEEPPGLLAPPARALGLDPRRDYATAVPRLLHGLADGAHGLADAPLGLPGLAAAPGLEDLQAMDEPGMSLLDQSVIKKVPIPSKASSLSALSLAKDSLVGGITNPGEVFCSVPGRLSLLSSTSKYKVTVGEVQRRLSPPECLNASLLGGVLRRAKSKNGGRCLRERLEKIGLNLPAGRRKAANVTLLTSLVEGEAVHLARDFGYVCETEFPAKAAAEYLCRQHADPGELHSRKSMLLAAKQICKEFADLMAQDRSPLGNSRPALILEPGVQSCLTHFSLITHGFGGPAICAALTAFQNYLLESLKGLDKMFLSSVGSGHGETKASEKDAKHRK

SEQ ID NO: 15757 - protein, 338 aa, Homo Sapiens
MEYFMVPTQKVPSLQHFRKTEKEVIGGLCSLANIPLTPETQRDQERRIRREIANSNERRRMQSINAGFQSLKTLIPHTDGEKLSKAAILQQTAEYIFSLEQEKTRLLQQNTQLKRFIQELSGSSPKRRRAEDKDEGIGSPDIWEDEKAEDLRREMIELRQQLDKERSVRMMLEEQVRSLEAHMYPEKLKVIAQQVQLQQQQEQVRLLHQEKLEREQQQLRTQLLPPPAPTHHPTVIVPAPPPPPSHHINVVTMGPSSVINSVSTSRQNLDTIVQAIQHIEGTQEKQELEEEQRRAVIVKPVRSCPEAPTSDTASDSEASDSDAMDQSREEPSGDGELP

SEQ ID NO: 15758 - protein, 346 aa, Homo Sapiens
MAASGKLSTCRLPPLPTIREIIKLLRLQAAKQLSQNFLLDLRLTDKIVRKAGNLTNAYVYEVGPGPGGITRSILNADVAELLVVEKDTRFIPGLQMLSDAAPGKLRIVHGDVLTFKVEKAFSESLKRPWEDDPPNVHIIGNLPFSVSTPLIIKWLENISCRDGPFVYGRTQMTLTFQKEVAERLAANTGSKQRSRLSVMAQYLCNVRHIFTIPGQAFVPKPEVDVGVVHFTPLIQPKIEQPFKLVEKVVQNVFQFRRKYCHRGLRMLFPEAQRLESTGRLLELADIDPTLRPRQLSISHFKSLCDVYRKMCDEDPQLFAYNFREELKRRKSKNEEKEEDDAENYRL

SEQ ID NO: 15759 - protein, 396 aa, Homo Sapiens
MWIPVVGLPRRLRLSALAGAGRFCILGSEAATRKHLPARNHCGLSDSSPQLWPEPDFRNPPRKASKASLDFKRYVTDRRLAETLAQIYLGKPSRPPHLLLECNPGPGILTQALLEAGAKVVALESDKTFIPHLESLGKNLDGKLRVIHCDFFKLDPRSGGVIKPPAMSSRGLFKNLGIEAVPWTADIPLKVVGMFPSRGEKRALWKLAYDLYSCTSIYKFGRIEVNMFIGEKEFQKLMADPGNPDLYHVLSVIWQLACEIKVLHMEPWSSFDIYTRKGPLENPKRRELLDQLQQKLYLIQMIPRQNLFTKNLTPMNYNIFFHLLKHCFGRRSATVIDHLRSLTPLDARDILMQIGKQEDEKVVNMHPQDFKTLFETIERSKDCAYKWLYDETLEDR

SEQ ID NO: 15760 - protein, 502 aa, Homo Sapiens
MAWALKLPLADEVIESGLVQDFDASLSGIGQELGAGAYSMSDVLALPIFKQEESSLPPDNENKILPFQYVLCAATSPAVKLHDETLTYLNQGQSYEIRMLDNRKLGELPEINGKLVKSIFRVVFHDRRLQYTEHQQLEGWRWNRPGDRILDIDIPMSVGIIDPRANPTQLNTVEFLWDPAKRTSVFIQVHCISTEFTMRKHGGEKGVPFRVQIDTFKENENGEYTEHLHSASCQIKVFKPKGADRKQKTDREKMEKRTPHEKEKYQPSYETTILTECSPWPEITYVNNSPSPGFNSSHSSFSLGEGNGSPNHQPEPPPPVTDNLLPTTTPQEAQQWLHRNRFSTFTRLFTNFSGADLLKLTRDDVIQICGPADGIRLFNALKGRMVRPRLTIYVCQESLQLREQQQQQQQQQQKHEDGDSNGTFFVYHAIYLEELTAVELTEKIAQLFSISPCQISQIYKQGPTGIHVLISDEMIQNFQEEACFILDTMKAETNDSYHIILK

SEQ ID NO: 15761 - protein, 479 aa, Homo Sapiens
MLFWHTQPEHYNQHNSGSYLRDVLALPIFKQEEPQLSPENEARLPPLQYVLCAATSPAVKLHEETLTYLNQGQSYEIRLLENRKLGDFQDLNTKYVKSIIRVVFHDRRLQYTEHQQLEGWRWSRPGDRILDIDIPLSVGILDPRASPTQLNAVEFLWDPAKRASAFIQVHCISTEFTPRKHGGEKGVPFRVQIDTFKQNENGEYTEHLHSASCQIKVFKPKGADRKQKTDREKMEKRTAQEKEKYQPSYETTILTECSPWPDVAYQVNSAPSPSYNGSPNSFGLGEGNASPTHPVEALPVGSDHLLPSASIQDAQQWLHRNRFSQFCRLFASFSGADLLKMSRDDLVQICGPADGIRLFNAIKGRNVRPKMTIYVCQELEQNRVPLQQKRDGSGDSNLSVYHAIFLEELTTLELIEKIANLYSISPQHIHRVYRQGPTGIHVVVSNEMVQNFQDESCFVLSTIKAESNDGYHIILKCGL

SEQ ID NO: 15762 - protein, 410 aa, Homo Sapiens
MAKDAGLIEANGELKVFIDQNLSPGKGVVSLVAVHPSTVNPLGKQLLPKTFGQSNVNIAQQVVIGTPQRPAASNTLVVGSPHTPSTHFASQNQPSDSSPWSAGKRNRKGEKNGKGLRHFSMKVCEKVQRKGTTSYNEVADELVAEFSAADNHILPNESAYDQKNIRRRVYDALNVLMAMNIISKEKKEIKWIGLPTNSAQECQNLEVERQRRLERIKQKQSQLQELILQQIAFKNLVQRNRHAEQQASRPPPPNSVIHLPFIIVNTSKKTVIDCSISNDKFEYLFNFDNTFEIHDDIEVLKRMGMACGLESGSCSAEDLKMARSLVPKALEPYVTEMAQGTVGGVFITTAGSTSNGTRFSASDLTNGADGMLATSSNGSQYSGSRVETPVSYVGEDDEEDDDFNENDEDD

SEQ ID NO: 15763 - protein, 446 aa, Homo Sapiens
MTAKNVGLTSTNAEVRGFIDQNLSPTKGNISFVAFPVSNTNSPTKILPKTLGPINVNVGPQMIISTPQRLTSSGSVLIGSPYTPAPAMVTQTHIAEATGWVPGDRKRARKFIDSDFSESKRSKKGDKNGKGLRHFSMKVCEKVQRKGTTSYNEVADELVSEFTNSNNHLAADSAYDQKNIRRRVYDALNVLMAMNIISKEKKEIKWIGLPTNSAQECQNLEIEKQRRIERIKQKRAQLQELLLQQIAFKNLVQRNRQNEQQNQGPPALNSTIQLPFIIINTSRKTVIDCSISSDKFEYLFNFDNTFEIHDDIEVLKRMGMSFGLESGKCSLEDLKLAKSLVPKALEGYITDISTGPSWLNQGLLLNSTQSVSNLDLTTGATLPQSSVNQGLCLDAEVALATGQFLAPNSHQSSSAASHCSESRGETPCSFNDEDEEDDEEDSSSPE

SEQ ID NO: 15764 - protein, 405 aa, Homo Sapiens
MAKYVSLTEANEELKVLMDENQTSRPVAVHTSTVNPLGKQLLPKTFGQSSVNIDQQVVIGMPQRPAASNIPVVGSPNPPSTHFASQNQHSYSSPPWAGQHNRKGEKNGMGLCRLSMKVWETVQRKGTTSCQEVVGELVAKFRAASNHASPNESAYDVKNIKRRTYDALNVLMAMNIISREKKKIKWIGLTTNSAQNCQNLRVERQKRLERIKQKQSELQQLILQQIAFKNLVLRNQYVEEQVSQRPLPNSVIHVPFIIISSSKKTVINCSISDDKSEYLFKFNSSFEIHDDTEVLMWMGMTFGLESGSCSAEDLKMARNLVPKALEPYVTEMAQGTFGGVFTTAGSRSNGTWLSASDLTNIAIGMLATSSGGSQYSGSRVETPAVEEEEEEDNNDDDLSENDEDD

SEQ ID NO: 15765 - protein, 575 aa, Homo Sapiens
MSHAAEPARDGVEASAEGPRAVFVLLEERRPADSAQLLSLNSLLPESGIVADIELENVLDPDSFYELKSQPLPLRSSLPISLQATPATPATLSASSSAGGSRTPAMSSSSSSRVLLRQQLMRAQAQEQERRERREQAAAAPFPSPAPASPAISVVGVSAGGHTLSRPPPAQVPREVLKVQTHLENPTRYHLQQARRQQVKQYLSTTLGPKLASQALTPPPGPASAQPLPAPEAAHTTGPTGSAPNSPMALLTIGSSSEKEIDDVIDEIISLESSYNDEMLSYLPGGTTGLQLPSTLPVSGNLLDVYSSQGVATPAITVSNSCPAELPNIKREISETEAKALLKERQKKDNHNLIERRRRFNINDRIKELGTLIPKSSDPEMRWNKGTILKASVDYIRKLQKEQQRSKDLESRQRSLEQANRSLQLRIQELELQAQIHGLPVPPTPGLLSLATTSASDSLKPEQLDIEEEGRPGAATFHVGGGPAQNAPHQQPPAPPSDALLDLHFPSDHLGDLGDPFHLGLEDILMEEEEGVVGGLSGGALSPLRAASDPLLSSVSPAVSKASSRRSSFSMEEES

SEQ ID NO: 15766 - protein, 476 aa, Homo Sapiens
MASRIGLRMQLMREQAQQEEQRERMQQQAVMHYMQQQQQQQQQQLGGPPTPAINTPVHFQSPPPVPGEVLKVQSYLENPTSYHLQQSQHQKVREYLSETYGNKFAAHISPAQGSPKPPPAASPGVRAGHVLSSSAGNSAPNSPMAMLHIGSNPERELDDVIDNIMRLDDVLGYINPEMQMPNTLPLSSSHLNVYSSDPQVTASLVGVTSSSCPADLTQKRELTDAESRALAKERQKKDNHNLIERRRRFNINDRIKELGMLIPKANDLDVRWNKGTILKASVDYIRRMQKDLQKSRELENHSRRLEMTNKQLWLRIQELEMQARVHGLPTTSPSGMNMAELAQQVVKQELPSEEGPGEALMLGAEVPDPEPLPALPPQAPLPLPTQPPSPFHHLDFSHSLSFGGREDEGPPGYPEPLAPGHGSPFPSLSKKDLDLMLLDDSLLPLASDPLLSTMSPEASKASSRRSSFSMEEGDVL

SEQ ID NO: 15767 - protein, 347 aa, Homo Sapiens
MTLDHQIINPTLKWSQPAVPSGGPLVQHAHTTLDSDAGLTENPLTKLLAIGKEDDNAQWHMEDVIEDIIGMESSFKEEGADSPLLMQRTLSGSILDVYSGEQGISPINMGLTSASCPSSLPMKREITETDTRALAKERQKKDNHNLIERRRRYNINYRIKELGTLIPKSNDPDMRWNKGTILKASVEYIKWLQKEQQRARELEHRQKKLEQANRRLLLRIQELEIQARTHGLPTLASLGTVDLGAHVTKQQSHPEQNSVDYCQQLTVSQGPSPELCDQAIAFSDPLSYFTDLSFSAALKEEQRLDGMLLDDTISPFGTDPLLSATSPAVSKESSRRSSFSSDDGDEL

SEQ ID NO: 15768 - protein, 401 aa, Homo Sapiens
MVLAQSRVSAGVGSPHCSGSGGGGSDSFPWPASHPGNPQCSFSTAFLASPRLSRGTLAYLPPAPWSSLATPSALLGSSCAPPPPPARCPQPRALSPELGTKAGPRRPHRWELPRSPSQGAQGPAPRRRLLETMKGIVAASGSETEDEDSMDIPLDLSSSAGSGKRRRRGNLPKESVQILRDWLYEHRYNAYPSEQEKALLSQQTHLSTLQVCNWFINARRRLLPDMLRKDGKDPNQFTISRRGAKISETSSVESVMGIKNFMPALEETPFHSCTAGPNPTLGRPLSPKPSSPGSVLARPSVICHTTVTALKDVPFSLCQSVGVGQNTDIQQIAAKNFTDTSLMYPEDTCKSGPSTNTQSGLFNTPPPTPPDLNQDFSGFQLLVDVALKRAAEMELQAKLTA

SEQ ID NO: 15769 - protein, 237 aa, Homo Sapiens
MSDSDLGEDEGLLSLAGKRKRRGNLPKESVKILRDWLYLHRYNAYPSEQEKLSLSGQTNLSVLQICNWFINARRRLLPDMLRKDGKDPNQFTISRRGGKASDVALPRGSSPSVLAVSVPAPTNVLSLSVCSMPLHSGQGEKPAAPFPRGELESPKPLVTPGSTLTLLTRAEAGSPTGGLFNTPPPTPPEQDKEDFSSFQLLVEVALQRAAEMELQKQQDPSLPLLHTPIPLVSENPQ

SEQ ID NO: 15770 - protein, 241 aa, Homo Sapiens
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLQISNWFINARRRILPDMLQQRRNDPIIGHKTGKDAHATHLQSTEASVPAKSGPSGPDNVQSLPLWPLPKGQMSREKQPDPESAPSQKLTGIAQPKKKVKVSVTSPSSPELVSPEEHADFSSFLLLVDAAVQRAAELELEKKQEPNP

SEQ ID NO: 15771 - protein, 185 aa, Homo Sapiens
MEAAADGPAETQSPVEKDSPAKTQSPAQDTSIMSRNNADTGRVLALPEHKKKRKGNLPAESVKILRDWMYKHRFKAYPSEEEKQMLSEKTNLSLLRISNWFINARRRILPDMLQQRRNDPIIGHKTGKDAHATHLQSTEASVPAKSGPVVQTMYKACPCGPCQRARCQERSNQIRSRPLARSSPE

SEQ ID NO: 15772 - protein, 213 aa, Homo Sapiens
MVQSCSAYGCKNRYDKDKPVSFHKFPLTRPSLCKEWEAAVRRKNFKPTKYSSICSEHFTPDCFKRECNNKLLKENAVPTIFLCTEPHDKKEDLLEPQEQLPPPPLPPPVSQVDAAIGLLMPPLQTPVNLSVFCDHNYTVEDTMHQRKRIHQLEQQVEKLRKKLKTAQQRCRRQERQLEKLKEVVHFQKEKDDVSERGYVILPNDYFEIVEVPA

SEQ ID NO: 15773 - protein, 257 aa, Homo Sapiens
MPARCVAAHCGNTTKSGKSLFRFPKDRAVRLLWDRFVRGCRADWYGGNDRSVICSDHFAPACFDVSSVIQKNLRFSQRLRLVAGAVPTLHRVPAPAPKRGEEGDQAGRLDTRGELQAARHSEAAPGPVSCTRPRAGKQAAASQITCENELVQTQPHADNPSNTVTSVPTHCEEGPVHKSTQISLKRPRHRSVGIQAKVKAFGKRLCNATTQTEELWSRTSSLFDIYSSDSETDTDWDIKSEQSDLSYMAVQVKEETC

SEQ ID NO: 15774 - protein, 314 aa, Homo Sapiens
MPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEEELLRKLNEQRDILALMEVKMKEMKGSIRHLRLTEAKLREELREKDRLLAMAVIRKKHGM

SEQ ID NO: 15775 - protein, 761 aa, Homo Sapiens
MPNFCAAPNCTRKSTQSDLAFFRFPRDPARCQKWVENCRRADLEDKTPDQLNKHYRLCAKHFETSMICRTSPYRTVLRDNAIPTIFDLTSHLNNPHSRHRKRIKELSEDEIRTLKQKKIDETSEQEQKHKETNNSNAQNPSEEEGEGQDEDILPLTLEEKENKEYLKSLFEILILMGKQNIPLDGHEADEIPEGLFTPDNFQALLECRINSGEEVLRKRFETTAVNTLFCSKTQQRQMLEICESCIREETLREVRDSHFFSIITDDVVDIAGEEHLPVLVRFVDESHNLREEFIGFLPYEADAEILAVKFHTMITEKWGLNMEYCRGQAYIVSSGFSSKMKVVASRLLEKYPQAIYTLCSSCALNMWLAKSVPVMGVSVALGTIEEVCSFFHRSPQLLLELDNVISVLFQNSKERGKELKEICHSQWTGRHDAFEILVELLQALVLCLDGINSDTNIRWNNYIAGRAFVLCSAVSDFDFIVTIVVLKNVLSFTRAFGKNLQGQTSDVFFAAGSLTAVLHSLNEVMENIEVYHEFWFEEATNLATKLDIQMKLPGKFRRAHQGNLESQLTSESYYKETLSVPTVEHIIQELKDIFSEQHLKALKCLSLVPSVMGQLKFNTSEEHHADMYRSDLPNPDTLSAELHCWRIKWKHRGKDIELPSTIYEALHLPDIKFFPNVYALLKVLCILPVMKVENERYENGRKRLKAYLRNTLTDQRSSNLALLNINFDIKHDLDLMVDTYIKLYTSKSELPTDNSETVENT

SEQ ID NO: 15776 - protein, 228 aa, Homo Sapiens
MPTNCAAAGCATTYNKHINISFHRFPLDPKRRKEWVRLVRRKNFVPGKHTFLCSKHFEASCFDLTGQTRRLKMDAVPTIFDFCTHIKSMKLKSRNLLKKNNSCSPAGPSNLKSNISSQQVLLEHSYAFRNPMEAKKRIIKLEKEIASLRRKMKTCLQKERRATRRWIKATCLVKNLEANSVLPKGTSEHMLPTALSSLPLEDFKILEQDQQDKTLLSLNLKQTKSTFI

SEQ ID NO: 15777 - protein, 239 aa, Homo Sapiens
MPKSCAARQCCNRYSSRRKQLTFHRFPFSRPELLKEWVLNIGRGNFKPKQHTVICSEHFRPECFSAFGNRKNLKHNAVPTVFAFQDPTQQVRENTDPASERGNASSSQKEKVLPEAGAGEDSPGRNMDTALEELQLPPNAEGHVKQVSPRRPQATEAVGRPTGPAGLRRTPNKQPSDHSYALLDLDSLKKKLFLTLKENEKLRKRLQAQRLVMRRMSSRLRACKGHQGLQARLGPEQQS

SEQ ID NO: 15778 - protein, 577 aa, Homo Sapiens
MVICCAAVNCSNRQGKGEKRAVSFHRFPLKDSKRLIQWLKAVQRDNWTPTKYSFLCSEHFTKDSFSKRLEDQHRLLKPTAVPSIFHLTEKKRGAGGHGRTRRKDASKATGGVRGHSSAATSRGAAGWSPSSSGNPMAKPESRRLKQAALQGEATPRAAQEAASQEQAQQALERTPGDGLATMVAGSQGKAEASATDAGDESATSSIEGGVTDKSGISMDDFTPPGSGACKFIGSLHSYSFSSKHTRERPSVPREPIDRKRLKKDVEPSCSGSSLGPDKGLAQSPPSSSLTATPQKPSQSPSAPPADVTPKPATEAVQSEHSDASPMSINEVILSASGACKLIDSLHSYCFSSRQNKSQVCCLREQVEKKNGELKSLRQRVSRSDSQVRKLQEKLDELRRVSVPYPSSLLSPSREPPKMNPVVEPLSWMLGTWLSDPPGAGTYPTLQPFQYLEEVHISHVGQPMLNFSFNSFHPDTRKPMHRECGFIRLKPDTNKVAFVSAQNTGVVEVEEGEVNGQELCIASHSIARISFAKEPHVEQITRKFRLNSEGKLEQTVSMATTTQPMTQHLHVTYKKVTP

SEQ ID NO: 15779 - protein, 395 aa, Homo Sapiens
MPRYCAAICCKNRRGRNNKDRKLSFYPFPLHDKERLEKWLKNMKRDSWVPSKYQFLCSDHFTPDSLDIRWGIRYLKQTAVPTIFSLPEDNQGKDPSKKKSQKKNLEDEKEVCPKAKSEESFVLNETKKNIVNTDVPHQHPELLHSSSLVKPPAPKTGSIQNNMLTLNLVKQHTGKPESTLETSVNQDTGRGGFHTCFENLNSTTITLTTSNSESIHQSLETQEVLEVTTSHLANPNFTSNSMEIKSAQENPFLFSTINQTVEELNTNKESVIAIFVPAENSKPSVNSFISAQKETTEMEDTDIEDSLYKDVDYGTEVLQIEHSYCRQDINKEHLWQKVSKLHSKITLLELKEQQTLGRLKSLEALIRQLKQENWLSEENVKIIENHFTTYEVTMI

SEQ ID NO: 15780 - protein, 222 aa, Homo Sapiens
MVKCCSAIGCASRCLPNSKLKGLTFHVFPTDENIKRKWVLAMKRLDVNAAGIWEPKKGDVLCSRHFKKTDFDRSAPNIKLKPGVIPSIFDSPYHLQGKREKLHCRKNFTLKTVPATNYNHHLVGASSCIEEFQSQFIFEHSYSVMDSPKKLKHKLDHVIGELEDTKESLRNVLDREKRFQKSLRKTIRELKDECLISQETANRLDTFCWDCCQESIEQDYIS

SEQ ID NO: 15781 - protein, 309 aa, Homo Sapiens
MPRHCSAAGCCTRDTRETRNRGISFHRLPKKDNPRRGLWLANCQRLDPSGQGLWDPASEYIYFCSKHFEEDCFELVGISGYHRLKEGAVPTIFESFSKLRRTTKTKGHSYPPGPAEVSRLRRCRKRCSEGRGPTTPFSPPPPADVTCFPVEEASAPATLPASPAGRLEPGLSSPFSDLLGPLGAQADEAGCSAQPSPERQPSPLEPRPVSPSAYMLRLPPPAGAYIQNEHSYQVGSALLWKRRAEAALDALDKAQRQLQACKRREQRLRLRLTKLQQERAREKRAQADARQTLKEHVQDFAMQLSSSMA

SEQ ID NO: 15782 - protein, 274 aa, Homo Sapiens
MPKYCRAPNCSNTAGRLGADNRPVSFYKFPLKDGPRLQAWLQHMGCEHWVPSCHQHLCSEHFTPSCFQWRWGVRYLRPDAVPSIFSRGPPAKSQRRTRSTQKPVSPPPPLQKNTPLPQSPAIPVSGPVRLVVLGPTSGSPKTVATMLLTPLAPAPTPERSQPEVPAQQAQTGLGPVLGALQRRVRRLQRCQERHQAQLQALERLAQQLHGESLLARARRGLQRLTTAQTLGPEESQTFTIICGGPDIAMVLAQDPAPATVDAKPELLDTRIPSA

SEQ ID NO: 15783 - protein, 903 aa, Homo Sapiens
MTRSCSAVGCSTRDTVLSRERGLSFHQFPTDTIQRSKWIRAVNRVDPRSKKIWIPGPGAILCSKHFQESDFESYGIRRKLKKGAVPSVSLYKIPQGVHLKGKARQKILKQPLPDNSQEVATEDHNYSLKTPLTIGAEKLAEVQQMLQVSKKRLISVKNYRMIKKRKGLRLIDALVEEKLLSEETECLLRAQFSDFKWELYNWRETDEYSAEMKQFACTLYLCSSKVYDYVRKILKLPHSSILRTWLSKCQPSPGFNSNIFSFLQRRVENGDQLYQYCSLLIKSMPLKQQLQWDPSSHSLQGFMDFGLGKLDADETPLASETVLLMAVGIFGHWRTPLGYFFVNRASGYLQAQLLRLTIGKLSDIGITVLAVTSDATAHSVQMAKALGIHIDGDDMKCTFQHPSSSSQQIAYFFDSCHLLRLIRNAFQNFQSIQFINGIAHWQHLVELVALEEQELSNMERIPSTLANLKNHVLKVNSATQLFSESVASALEYLLSLDLPPFQNCIGTIHFLRLINNLFDIFNSRNCYGKGLKGPLLPETYSKINHVLIEAKTIFVTLSDTSNNQIIKGKQKLGFLGFLLNAESLKWLYQNYVFPKVMPFPYLLTYKFSHDHLELFLKMLRQVLVTSSSPTCMAFQKAYYNLETRYKFQDEVFLSKVSIFDISIARRKDLALWTVQRQYGVSVTKTVFHEEGICQDWSHCSLSEALLDLSDHRRNLICYAGYVANKLSALLTCEDCITALYASDLKASKIGSLLFVKKKNGLHFPSESLCRVINICERVVRTHSRMAIFELVSKQRELYLQQKILCELSGHINLFVDVNKHLFDGEVCAINHFVKLLKDIIICFLNIRAKNVAQNPLKHHSERTDMKTLSRKHWSSVQDYKCSSFANTSSKFRHLLSNDGYPFK

SEQ ID NO: 15784 - protein, 539 aa, Homo Sapiens
MGSPEDDLIGIPFPDHSSELLSCLNEQRQLGHLCDLTIRTQGLEYRTHRAVLAACSHYFKKLFTEGGGGAVMGAGGSGTATGGAGAGVCELDFVGPEALGALLEFAYTATLTTSSANMPAVLQAARLLEIPCVIAACMEILQGSGLEAPSPDEDDCERARQYLEAFATATASGVPNGEDSPPQVPLPPPPPPPPRPVARRSRKPRKAFLQTKGARANHLVPEVPTVPAHPLTYEEEEVAGRVGSSGGSGPGDSYSPPTGTASPPEGPQSYEPYEGEEEEEELVYPPAYGLAQGGGPPLSPEELGSDEDAIDPDLMAYLSSLHQDNLAPGLDSQDKLVRKRRSQMPQECPVCHKIIHGAGKLPRHMRTHTGEKPFACEVCGVRFTRNDKLKIHMRKHTGERPYSCPHCPARFLHSYDLKNHMHLHTGDRPYECHLCHKAFAKEDHLQRHLKGQNCLEVRTRRRRKDDAPPHYPPPSTAAASPAGLDLSNGHLDTFRLSLARFWEQSAPTGPPVSTPGPPDDDEEEGAPTTPQAEGAMESS

SEQ ID NO: 15785 - protein, 490 aa, Homo Sapiens
MEQKPSKVECGSDPEENSARSPDGKRKRKNGQCSLKTSMSGYIPSYLDKDEQCVVCGDKATGYHYRCITCEGCKGFFRRTIQKNLHPTYSCKYDSCCVIDKITRNQCQLCRFKKCIAVGMAMDLVLDDSKRVAKRKLIEQNRERRRKEEMIRSLQQRPEPTPEEWDLIHIATEAHRSTNAQGSHWKQRRKFLPDDIGQSPIVSMPDGDKVDLEAFSEFTKIITPAITRVVDFAKKLPMFSELPCEDQIILLKGCCMEIMSLRAAVRYDPESDTLTLSGEMAVKREQLKNGGLGVVSDAIFELGKSLSAFNLDDTEVALLQAVLLMSTDRSGLLCVDKIEKSQEAYLLAFEHYVNHRKHNIPHFWPKLLMKEREVQSSILYKGAAAEGRPGGSLGVHPEGQQLLGMHVVQGPQVRQLEQQLGEAGSLQGPVLQHQSPKSPQQRLLELLHRSGILHARAVCGEDDSSEADSPSSSEEEPEVCEDLAGNAASP

SEQ ID NO: 15786 - protein, 461 aa, Homo Sapiens
MTPNSMTENGLTAWDKPKHCPDREHDWKLVGMSEACLHRKSHSERRSTLKNEQSSPHLIQTTWTSSIFHLDHDDVNDQSVSSAQTFQTEEKKCKGYIPSYLDKDELCVVCGDKATGYHYRCITCEGCKGFFRRTIQKNLHPSYSCKYEGKCVIDKVTRNQCQECRFKKCIYVGMATDLVLDDSKRLAKRKLIEENREKRRREELQKSIGHKPEPTDEEWELIKTVTEAHVATNAQGSHWKQKRKFLPEDIGQAPIVNAPEGGKVDLEAFSHFTKIITPAITRVVDFAKKLPMFCELPCEDQIILLKGCCMEIMSLRAAVRYDPESETLTLNGEMAVTRGQLKNGGLGVVSDAIFDLGMSLSSFNLDDTEVALLQAVLLMSSDRPGLACVERIEKYQDSFLLAFEHYINYRKHHVTHFWPKLLMKVTDLRMIGACHASRFLHMKVECPTELFPPLFLEVFED

SEQ ID NO: 15787 - protein, 330 aa, Homo Sapiens
MEHLGPHHLHPGHAEPISFGIDQILNSPDQGGCMGPASRLQDGEYGLGCLVGGAYTYGGGGSAAATGAGGAGAYGTGGPGGPGGPAGGGGACSMGPLTGSYNVNMALAGGPGPGGGGGSSGGAGALSAAGVIRVPAHRPLAGAVAHPQPLATGLPTVPSVPAMPGVNNLTGLTFPWMESNRRYTKDRFTGHPYQNRTPPKKKKPRTSFTRLQICELEKRFHRQKYLASAERAALAKALKMTDAQVKTWFQNRRTKWRRQTAEEREAERQQANRILLQLQQEAFQKSLAQPLPADPLCVHNSSLFALQNLQPWSDDSTKITSVTSVASACE

SEQ ID NO: 15788 - protein, 284 aa, Homo Sapiens
MEPGMLGPHNLPHHEPISFGIDQILSGPETPGGGLGLGRGGQGHGENGAFSGGYHGASGYGPAGSLAPLPGSSGVGPGGVIRVPAHRPLPVPPPAGGAPAVPGPSGLGGAGGLAGLTFPWMDSGRRFAKDRLTAALSPFSGTRRIGHPYQNRTPPKRKKPRTSFSRSQVLELERRFLRQKYLASAERAALAKALRMTDAQVKTWFQNRRTKWRRQTAEEREAERHRAGRLLLHLQQDALPRPLRPPLPPDPLCLHNSSLFALQNLQPWAEDNKVASVSGLASVV

SEQ ID NO: 15789 - protein, 291 aa, Homo Sapiens
MEAPASAQTPHPHEPISFGIDQILNSPDQDSAPAPRGPDGASYLGGPPGGRPGATYPSLPASFAGLGAPFEDAGSYSVNLSLAPAGVIRVPAHRPLPGAVPPPLPSALPAMPSVPTVSSLGGLNFPWMESSRRFVKDRFTAAAALTPFTVTRRIGHPYQNRTPPKRKKPRTSFSRVQICELEKRFHRQKYLASAERAALAKSLKMTDAQVKTWFQNRRTKWRRQTAEEREAERQQASRLMLQLQHDAFQKSLNDSIQPDPLCLHNSSLFALQNLQPWEEDSSKVPAVTSLV

SEQ ID NO: 15790 - protein, 510 aa, Homo Sapiens
MAADSDDGAVSAPAASDGGVSKSTTSGEELVVQVPVVDVQSNNFKEMWPSLLLAIKTANFVAVDTELSGLGDRKSLLNQCIEERYKAVCHAARTRSILSLGLACFKRQPDKGEHSYLAQVFNLTLLCMEEYVIEPKSVQFLIQHGFNFNQQYAQGIPYHKGNDKGDESQSQSVRTLFLELIRARRPLVLHNGLIDLVFLYQNFYAHLPESLGTFTADLCEMFPAGIYDTKYAAEFHARFVASYLEYAFRKCERENGKQRAAGSPHLTLEFCNYPSSMRDHIDYRCCLPPATHRPHPTSICDNFSAYGWCPLGPQCPQSHDIDLIIDTDEAAAEDKRRRRRRREKRKRALLNLPGTQTSGEAKDGPPKKQVCGDSIKPEETEQEVAADETRNLPHSKQGNKNDLEMGIKAARPEIADRATSEVPGSQASPNPVPGDGLHRAGFDAFMTGYVMAYVEVSQGPQPCSSGPWLPECHNKVYLSGKAVPLTVAKSQFSRSSKAHNQKMKLTWGSS

SEQ ID NO: 15791 - protein, 1378 aa, Homo Sapiens
MSLERELRQLSKAKAKAQRAGQRREEAALCHQLGELLAGHGRYAEALEQHWQELQLRERADDPLGCAVAHRKIGERLAEMEDYPAALQHQHQYLELAHSLRNHTELQRAWATIGRTHLDIYDHCQSRDALLQAQAAFEKSLAIVDEELEGTLAQGELNEMRTRLYLNLGLTFESLQQTALCNDYFRKSIFLAEQNHLYEDLFRARYNLGTIHWRAGQHSQAMRCLEGARECAHTMRKRFMESECCVVIAQVLQDLGDFLAAKRALKKAYRLGSQKPVQRAAICQNLQHVLAVVRLQQQLEEAEGRDPQGAMVICEQLGDLFSKAGDFPRAAEAYQKQLRFAELLDRPGAERAIIHVSLATTLGDMKDHHGAVRHYEEELRLRSGNVLEEAKTWLNIALSREEAGDAYELLAPCFQKALSCAQQAQRPQLQRQVLQHLHTVQLRLQPQEAPETETRLRELSVAEDEDEEEEAEEAAATAESEALEAGEVELSEGEDDTDGLTPQLEEDEELQGHLGRRKGSKWNRRNDMGETLLHRACIEGQLRRVQDLVRQGHPLNPRDYCGWTPLHEACNYGHLEIVRFLLDHGAAVDDPGGQGCEGITPLHDALNCGHFEVAELLLERGASVTLRTRKGLSPLETLQQWVKLYRRDLDLETRQKARAMEMLLQAAASGQDPHSSQAFHTPSSLLFDPETSPPLSPCPEPPSNSTRLPEASQAHVRVSPGQAAPAMARPRRSRHGPASSSSSSEGEDSAGPARPSQKRPRCSATAQRVAAWTPGPASNREAATASTSRAAYQAAIRGVGSAQSRLGPGPPRGHSKALAPQAALIPEEECLAGDWLELDMPLTRSRRPRPRGTGDNRRPSSTSGSDSEESRPRARAKQVRLTCMQSCSAPVNAGPSSLASEPPGSPSTPRVSEPSGDSSAAGQPLGPAPPPPIRVRVQVQDHLFLIPVPHSSDTHSVAWLAEQAAQRYYQTCGLLPRLTLRKEGALLAPQDLIPDVLQSNDEVLAEVTSWDLPPLTDRYRRACQSLGQGEHQQVLQAVELQGLGLSFSACSLALDQAQLTPLLRALKLHTALRELRLAGNRLGDKCVAELVAALGTMPSLALLDLSSNHLGPEGLRQLAMGLPGQATLQSLEELDLSMNPLGDGCGQSLASLLHACPLLSTLRLQACGFGPSFFLSHQTALGSAFQDAEHLKTLSLSYNALGAPALARTLQSLPAGTLLHLELSSVAAGKGDSDLMEPVFRYLAKEGCALAHLTLSANHLGDKAVRDLCRCLSLCPSLISLDLSANPEISCASLEELLSTLQKRPQGLSFLGLSGCAVQGPLGLGLWDKIAAQLRELQLCSRRLCAEDRDALRQLQPSRPGPGECTLDHGSKLFFRRL

SEQ ID NO: 15792 - protein, 1045 aa, Homo Sapiens
MGSQPPLGSPLSREEGEAPPPAPASEGRRRSRRVRLRGSCRHRPSFLGCRELAASAPARPAPASSEIMASAAKEFKMDNFSPKAGTSKLQQTVPADASPDSKCPICLDRFDNVSYLDRCLHKFCFRCVQEWSKNKAECPLCKQPFDSIFHSVRAEDDFKEYVLRPSYNGSFVTPDRRFRYRTTLTRERNASVYSPSGPVNRRTTTPPDSGVLFEGLGISTRPRDVEIPQFMRQIAVRRPTTADERSLRKIQEQDIINFRRTLYRAGARVRNIEDGGRYRDISAEFFRRNPACLHRLVPWLKRELTVLFGAHGSLVNIVQHIIMSNVTRYDLESQAFVSDLRPFLLNRTEHFIHEFISFARSPFNMAAFDQHANYDCPAPSYEEGSHSDSSVITISPDEAETQELDINVATVSQAPWDDETPGPSYSSSEQVHVTMSSLLNTSDSSDEELVTGGATSQIQGVQTNDDLNNDSDDSSDNCVIVGFVKPLAERTPELVELSSDSEDLGSYEKMETVKTQEQEQSYSSGDSDVSRCSSPHSVLGKDEQINKGHCDSSTRIKSKKEEKRSTSLSSPRNLNSSVRGDRVYSPYNHRHRKRGRSRSSDSRSQSRSGHDQKNHRKHHGKKRMKSKRSRSRESSRPRGRRDKKRSRTRDSSWSRRSQTLSLSSESTSRSRSRSSDHGKRRSRSRNRDRYYLRNNYGSRYKWEYTYYSRNKDRDGYESSYRRRTLSRAHYSRQSSSPEFRVQSFSERTNARKKNNHSERKYYYYERHRSRSLSSNRSRTASTGTDRVRNEKPGGKRKYKTRHLEGTNEVAQPSREFASKAKDSHYQKSSSKLDGNYKNESDTFSDSRSSDRETKHKRRKRKTRSLSVEIVYEGKATDTTKHHKKKKKKHKKKHKKHHGDNASRSPVVITIDSDSDKDSEVKEDTECDNSGPQDPLQNEFLAPSLEPFETKDVVTIEAEFGVLDKECDIATLSNNLNNANKTVDNIPPLAASVEQTLDVREESTFVSDLENQPSNIVSLQTEPSRQLPSPRTSLMSVCLGRDCDMS

SEQ ID NO: 15793 - protein, 526 aa, Homo Sapiens
MDVRFYPPPAQPAAAPDAPCLGPSPCLDPYYCNKFDGENMYMSMTEPSQDYVPASQSYPGPSLESEDFNIPPITPPSLPDHSLVHLNEVESGYHSLCHPMNHNGLLPFHPQNMDLPEITVSNMLGQDGTLLSNSISVMPDIRNPEGTQYSSHPQMAAMRPRGQPADIRQQPGMMPHGQLTTINQSQLSAQLGLNMGGSNVPHNSPSPPGSKSATPSPSSSVHEDEGDDTSKINGGEKRPASDMGKKPKTPKKKKKKDPNEPQKPVSAYALFFRDTQAAIKGQNPNATFGEVSKIVASMWDGLGEEQKQVYKKKTEAAKKEYLKQLAAYRASLVSKSYSEPVDVKTSQPPQLINSKPSVFHGPSQAHSALYLSSHYHQQPGMNPHLTAMHPSLPRNIAPKPNNQMPVTVSIANMAVSPPPPLQISPPLHQHLNMQQHQPLTMQQPLGNQLPMQVQSALHSPTMQQGFTLQPDYQTIINPTSTAAQVVTQAMEYVRSGCRNPPPQPVDWNNDYCSSGGMQRDKALYLT

SEQ ID NO: 15794 - protein, 488 aa, Homo Sapiens
MQQTRTEAVAGAFSRCLGFCGMRLGLLLLARHWCIAGVFPQKFDGDSAYVGMSDGNPELLSTSQTYNGQSENNEDYEIPPITPPNLPEPSLLHLGDHEASYHSLCHGLTPNGLLPAYSYQAMDLPAIMVSNMLAQDSHLLSGQLPTIQEMVHSEVAAYDSGRPGPLLGRPAMLASHMSALSQSQLISQMGIRSSIAHSSPSPPGSKSATPSPSSSTQEEESEVHFKISGEKRPSADPGKKAKNPKKKKKKDPNEPQKPVSAYALFFRDTQAAIKGQNPSATFGDVSKIVASMWDSLGEEQKQSSPDQGETKSTQANPPAKMLPPKQPMYAMPGLASFLTPSDLQAFRSGASPASLARTLGSKSLLPGLSASPPPPPSFPLSPTLHQQLSLPPHAQGALLSPPVSMSPAPQPPVLPTPMALQVQLAMSPSPPGPQDFPHISEFPSSSGSCSPGPSNPTSSGDWDSSYPSGECGISTCSLLPRDKSLYLT

SEQ ID NO: 15795 - protein, 576 aa, Homo Sapiens
MDVRFYPAAAGDPASLDFAQCLGYYGYSKFGNNNNYMNMAEANNAFFAASEQTFHTPSLGDEEFEIPPITPPPESDPALGMPDVLLPFQALSDPLPSQGSEFTPQFPPQSLDLPSITISRNLVEQDGVLHSSGLHMDQSHTQVSQYRQDPSLIMRSIVHMTDAARSGVMPPAQLTTINQSQLSAQLGLNLGGASMPHTSPSPPASKSATPSPSSSINEEDADEANRAIGEKRAAPDSGKKPKTPKKKKKKDPNEPQKPVSAYALFFRDTQAAIKGQNPNATFGEVSKIVASMWDSLGEEQKQVYKRKTEAAKKEYLKALAAYRASLVSKAAAESAEAQTIRSVQQTLASTNLTSSLLLNTPLSQHGTVSASPQTLQQSLPRSIAPKPLTMRLPMNQIVTSVTIAANMPSNIGAPLISSMGTTMVGSAPSTQVSPSVQTQQHQMQLQQQQQQQQQQMQQMQQQQLQQHQMHQQIQQQMQQQHFQHHMQQHLQQQQQHLQQQINQQQLQQQLQQRLQLQQLQHMQHQSQPSPRQHSPVASQITSPIPAIGSPQPASQQHQSQIQSQTQTQVLSQVSIF

SEQ ID NO: 15796 - protein, 621 aa, Homo Sapiens
MEFPGGNDNYLTITGPSHPFLSGAETFHTPSLGDEEFEIPPISLDSDPSLAVSDVVGHFDDLADPSSSQDGSFSAQYGVQTLDMPVGMTHGLMEQGGGLLSGGLTMDLDHSIGTQYSANPPVTIDVPMTDMTSGLMGHSQLTTIDQSELSSQLGLSLGGGTILPPAQSPEDRLSTTPSPTSSLHEDGVEDFRRQLPSQKTVVVEAGKKQKAPKKRKKKDPNEPQKPVSAYALFFRDTQAAIKGQNPNATFGEVSKIVASMWDSLGEEQKQVYKRKTEAAKKEYLKALAAYKDNQECQATVETVELDPAPPSQTPSPPPMATVDPASPAPASIEPPALSPSIVVNSTLSSYVANQASSGAGGQPNITKLIITKQMLPSSITMSQGGMVTVIPATVVTSRGLQLGQTSTATIQPSQQAQIVTRSVLQAAAAAAAAASMQLPPPRLQPPPLQQMPQPPTQQQVTILQQPPPLQAMQQPPPQKVRINLQQQPPPLQIKSVPLPTLKMQTTLVPPTVESSPERPMNNSPEAHTVEAPSPETICEMITDVVPEVESPSQMDVELVSGSPVALSPQPRCVRSGCENPPIVSKDWDNEYCSNECVVKHCRDVFLAWVASRNSNTVVFVK

SEQ ID NO: 15797 - protein, 393 aa, Homo Sapiens [sequence omitted]

SEQ ID NO: 15798 - protein, 680 aa, Homo Sapiens
MNFETSRCATLQYCPDPYIQRFVETPAHFSWKESYYRSTMSQSTQTNEFLSPEVFQHIWDFLEQPICSVQPIDLNFVDEPSEDGATNKIEISMDCIRMQDSDLSDPMWPQYTNLGLLNSMDQQIQNGSSSTSPYNTDHAQNSVTAPSPYAQPSSTFDALSPSPAIPSNTDYPGPHSFDVSFQQSSTAKSATWTYSTELKKLYCQIAKTCPIQIKVMTPPPQGAVIRAMPVYKKAEHVTEVVKRCPNHELSREFNEGQIAPPSHLIRVEGNSHAQYVEDPITGRQSVLVPYEPPQVGTEFTTVLYNFMCNSSCVGGMNRRPILIIVTLETRDGQVLGRRCFEARICACPGRDRKADEDSIRKQQVSDSTKNGDGTKRPFRQNTHGIQMTSIKKRRSPDDELLYLPVRGRETYEMLLKIKESLELMQYLPQHTIETYRQQQQQQHQHLLQKQTSIQSPSSYGNSSPPLNKMNSMNKLPSVSQLINPQQRNALTPTTIPDGMGANIPMMGTHMPMAGDMNGLSPTQALPPPLSMPSTSHCTPPPPYPTDCSIVSFLARLGCSSCLDYFTTQGLTTIYQIEHYSMDDLASLKIPEQFRHAIWKGILDHRQLHEFSSPSHLLRTPSSASTVSVGSSETRGERVIDAVRFTLRQTISFPPRDEWNDFNFDMDARRNKQQRIKEEGE

SEQ ID NO: 15799 - protein, 636 aa, Homo Sapiens
MAQSTATSPDGGTTFEHLWSSLEPDSTYFDLPQSSRGNNEVVGGTDSSMDVFHLEGMTTSVMAQFNLLSSTMDQMSSRAASASPYTPEHAASVPTHSPYAQPSSTFDTMSPAPVIPSNTDYPGPHHFEVTFQQSSTAKSATWTYSPLLKKLYCQIAKTCPIQIKVSTPPPPGTAIRAMPVYKKAEHVTDVVKRCPNHELGRDFNEGQSAPASHLIRVEGNNLSQYVDDPVTGRQSVVVPYEPPQVGTEFTTILYNFMCNSSCVGGMNRRPILIIITLEMRDGQVLGRRSFEGRICACPGRDRKADEDHYREQQALNESSAKNGAASKRAFKQSPPAVPALGAGVKKRRHGDEDTYYLQVRGRENFEILMKLKESLELMELVPQPLVDSYRQQQQLLQRPSHLQPPSYGPVLSPMNKVHGGMNKLPSVNQLVGQPPPHSSAATPNLGPVGPGMLNNHGHAVPANGEMSSSHSAQSMVSGSHCTPPPPYHADPSLVSFLTGLGCPNCIEYFTSQGLQSIYHLQNLTIEDLGALKIPEQYRMTIWRGLQDLKQGHDYSTAQQLLRSSNAATISIGGSGELQRQRVMEAVHFRVRHTITIPNRGGPGGGPDEWADFGFDLPDCKARKQPIKEEFTEAEIH

SEQ ID NO: 15800 - protein, 411 aa, Homo Sapiens
MLSLREQQLQVWFKNRRAKLARERRLQQQPQRVPGQRGRGARAAPLVPAASASAPQRGPSGILPAAEPTICSLHQAWGGPGCRAQKGIPAALSPGPGPIPAPIPGPAQIPGPLPGSIPGPIPGPAQIPSPIPAPIPGPISGPVQIPGPFRGPIPGPISGPAPIPGPISGPFSGPNPGPIPGPNPGPIPGPISGPIPGPISVPIPGPIPGPISGPISGPNPGPIPGPIPGPISGPNPGPIPGPISGPNPGLIPGPIPGPISGPGPIIGPIPSPAQIPGPGRLQGPGPILSPGRMRSPGSLPGLAPILGPGSGPGSGSVPAPIPGPGSLPAPAPLWPQSPDASDFLPDTQLFPHFTELLLPLDPLEGSSVSTMTSQYQEGDDSMGKKHSGSQPQEEGGSVNENHSGPRLLLDL

SEQ ID NO: 15801 - protein, 258 aa, Homo Sapiens
MTHDKSWRRCSISGSTKCRCGSRIAGPNALGSGGSRSSSSSSRSILSSSILSSSIPSSSSSSSSPSSSHSSSSPSSSHSSSSPSSSSSTSSPSSSSSSSSSSSPSSSNSSSSSSSSSPSSSSSSSSSSPSSSSSSPSSSSSSSSSSPSSSSSSPSSSSSSSSSSSSSPSSSSPSSSGSSPSSSNSSPSSSSSSPSSSSSSPSPRSSSPSSSSSSTSSPSTSSPSSSSPSSSSPSSSCPSAALGRRPQSPQSSHCAPFP

SEQ ID NO: 15802 - protein, 1200 aa, Homo Sapiens
MGDQQLYKTNHVAHGSENLFYQQPPLGVHSGLNHNYGNAVTGGGMDAPQASPISPHFPQDTRDGLGLPVGSKNLGQMDTSRQGGWGSHAGPGNHVQLRGNLANSNMMWGAPAQAEPTDGYQYTYSQASEIRTQKLTSGVLHKLDSFTQVFANQNLRIQVNNMAQVLHTQSAVMDGAPDSALRQLLSQKPMEPPAPAIPSRYQQVPQQPHPGFTGGLSKPALQVGQHPTQGHLYYDYQQPLAQVPVQGGQPLQAPQMLSQHMQQMQQHQYYPPQQQQQAGQQRISMQEIQTQPQQIRPSQPQPPPQQQQPQQLQLQQRQGSMQIPQYYQPQPMMQHLQEQQQQQMHLQPPSYHRDPHQYTPEQAHTVQLIPLGSMSQYYYQEPQQPYSHPLYQQSHLSQHQQREDSQLKTYSSDRQAQAMLSSHGDLGPPDTGMGDPASSDLTRVSSTLPHRPLLSPSGIHLNNMGPQHQQLSPSAMWPQMHLPDGRAQPGSPESSGQPKGAFGEQFDAKNKLTCSICLKEFKNLPALNGHMRSHGGMRASPNLKQEEGEKVLPPQPQPPLPPPPPPPPPPQLPPEAESLTPMVMPVSVPVKLLPPKPSSQGFTNSTVAAPSARDKPASSMSDDEMPVLEIPRKHQPSVPKAEEPLKTVQEKKKFRHRPEPLFIPPPPSYNPNPAASYSGATLYQSQLRSPRVLGDHLLLDPTHELPPYTPPPMLSPVRQGSGLFSNVLISGHGPGAHPQLPLTPLTPTPRVLLCRSNSIDGSNVTVTPGPGEQTVDVEPRINIGLRFQAEIPELQDISALAQDTHKATLVWKPWPELENHDLQQRVENLLNLCCSSALPGGGTNSEFALHSLFEAKGDVMVALEMLLLRKPVRLKCHPLANYHYAGSDKWTSLERKLFNKALATYSKDFIFVQKMVKSKTVAQCVEYYYTWKKIMRLGRKHRTRLAEIIDDCVTSEEEEELEEEEEEDPEEDRKSTKEEESEVPKSPEPPPVPVLAPTEGPPLQALGQPSGSFICEMPNCGAVFSSRQALNGHARIHGGTNQVTKARGAIPSGKQKPGGTQSGYCSVKSSPSHSTTSGETDPTTIFPCKECGKVFFKIKSRNAHMKTHRQQEEQQRQKAQKAAFAAEMAATIERTTGPVGAPGLLPLDQLSLIKPIKDVDILDDDVVQQLGGVMEEAEVVDTDLLLDDQDSVLLQGDAEL

SEQ ID NO: 15803 - protein, 1281 aa, Homo Sapiens
MVRKKNPPLRNVASEGEGQILEPIGTESKVSGKNKEFSADQMSENTDQSDAAELNHKEEHSLHVQDPSSSSKKDLKSAVLSEKAGFNYESPSKGGNFPSFPHDEVTDRNMLAFSSPAAGGVCEPLKSPQRAEADDPQDMACTPSGDSLETKEDQKMSPKATEETGQAQSGQANCQGLSPVSVASKNPQVPSDGGVRLNKSKTDLLVNDNPDPAPLSPELQDFKCNICGYGYYGNDPTDLIKHFRKYHLGLHNRTRQDAELDSKILALHNMVQFSHSKDFQKVNRSVFSGVLQDINSSRPVLLNGTYDVQVTSGGTFIGIGRKTPDCQGNTKYFRCKFCNFTYMGNSSTELEQHFLQTHPNKIKASLPSSEVAKPSEKNSNKSIPALQSSDSGDLGKWQDKITVKAGDDTPVGYSVPIKPLDSSRQNGTEATSYYWCKFCSFSCESSSSLKLLEHYGKQHGAVQSGGLNPELNDKLSRGSVINQNDLAKSSEGETMTKTDKSSSGAKKKDFSSKGAEDNMVTSYNCQFCDFRYSKSHGPDVIVVGPLLRHYQQLHNIHKCTIKHCPFCPRGLCSPEKHLGEITYPFACRKSNCSHCALLLLHLSPGAAGSSRVKHQCHQCSFTTPDVDVLLFHYESVHESQASDVKQEANHLQGSDGQQSVKESKEHSCTKCDFITQVEEEISRHYRRAHSCYKCRQCSFTAADTQSLLEHFNTVHCQEQDITTANGEEDGHAISTIKEEPKIDFRVYNLLTPDSKMGEPVSESVVKREKLEEKDGLKEKVWTESSSDDLRNVTWRGADILRGSPSYTQASLGLLTPVSGTQEQTKTLRDSPNVEAAHLARPIYGLAVETKGFLQGAPAGGEKSGALPQQYPASGENKSKDESQSLLRRRRGSGVFCANCLTTKTSLWRKNANGGYVCNACGLYQKLHSTPRPLNIIKQNNGEQIIRRRTRKRLNPEALQAEQLNKQQRGSNEEQVNGSPLERRSEDHLTESHQREIPLPSLSKYEAQGSLTKSHSAQQPVLVSQTLDIHKRMQPLHIQIKSPQESTGDPGNSSSVSEGKGSSERGSPIEKYMRPAKHPNYSPPGSPIEKYQYPLFGLPFVHNDFQSEADWLRFWSKYKLSVPGNPHYLSHVPGLPNPCQNYVPYPTFNLPPHFSAVGSDNDIPLDLAIKHSRPGPTANGASKEKTKAPPNVKNEGPLNVVKTEKVDRSTQDELSTKCVHCGIVFLDEVMYALHMSCHGDSGPFQCSICQHLCTDKYDFTTHIQRGLHRNNAQVEKNGKPKE

SEQ ID NO: 15804 - protein, 1073 aa, Homo Sapiens
MHQPPESTAAAAAAADISARKMAHPAMFPRRGSGSGSASALNAAGTGVGSNATSSEDFPPPSLLQPPPPAASSTSGPQPPPPQSLNLLSQAQLQAQPLAPGGTQMKKKSGFQITSVTPAQISASISSNNSIAEDTESYDDLDESHTEDLSSSEILDVSLSRATDLGEPERSSSEETLNNFQEAETPGAVSPNQPHLPQPHLPHLPQQNVVINGNAHPHHLHHHHQIHHGHHLQHGHHHPSHVAVASASITGGPPSSPVSRKLSTTGSSDSITPVAPTSAVSSSGSPASVMTNMRAPSTTGGIGINSVTGTSTVNNVNITAVGSFNPNVTSSMLGNVNISTSNIPSAAGVSVGPGVTSGVNVNILSGMGNGTISSSAAVSSVPNAAAGMTGGSVSSQQQQPTVNTSRFRVVKLDSSSEPFKKGRWTCTEFYEKENAVPATEGVLINKVVETVKQNPIEVTSERESTSGSSVSSSVSTLSHYTESVGSGEMGAPTVVVQQQQQQQQQQQQQPALQGVTLQQMDFGSTGPQSIPAVSIPQSISQSQISQVQLQSQELSYQQKQGLQPVPLQATMSAATGIQPSPVNVVGVTSALGQQPSISSLAQPQLPYSQAAPPVQTPLPGAPPPQQLQYGQQQPMVSTQMAPGHVKSVTQNPASEYVQQQPILQTAMSSGQPSSAGVGAGTTVIPVAQPQGIQLPVQPTAVPAQPAGASVQPVGQAPAAVSAVPTGSQIANIGQQANIPTAVQQPSTQVPPSVIQQGAPPSSQVVPPAQTGIIHQGVQTSAPSLPQQLVIASQSSLLTVPPQPQGVEPVAQGIVSQQLPAVSSLPSASSISVTSQVSSTGPSGMPSAPTNLVPPQNIAQTPATQNGNLVQSVSQPPLIATNTNLPLAQQIPLSSTQFSAQSLAQAIGSQIEDARRAAEPSLVGLPQTISGDSGGMSAVSDGSSSSLAASASLFPLKVLPLTTPLVDGEDESSSGASVVAIDNKIEQAMDLVKSHLMYAVREEVEVLKEQIKELIEKNSQLEQENNLLKTLASPEQLAQFQAQLQTGSPPATTQPQGTTQPPAQPASQGSGPTA

SEQ ID NO: 15805 - protein, 780 aa, Homo Sapiens
MSKMPAKKKSCFQITSVTTAQVATSITEDTESLDDPDESRTEDVSSEIFDVSRATDYGPEEVCERSSSEETLNNVGDAETPGTVSPNLLLDGQLAAAAAAPANGGGVVSARSVSGALASTLAAAATSAPAPGAPGGPQLAGSSAGPVTAAPSQPPTTCSSRFRVIKLDHGSGEPYRRGRWTCMEYYERDSDSSVLTRSGDCIRHSSTFDQTAERDSGLGATGGSVVVVVASMQGAHGPESGTDSSLTAVSQLPPSEKMSQPTPAQPQSFSVGQPQPPPPPVGGAVAQSSAPLPPFPGAATGPQPMMAAAQPSQPQGAGPGGQTLPPTNVTLAQPAMSLPPQPGPAVGAPAAQQPQQFAYPQPQIPPGHLLPVQPSGQSEYLQQHVAGLQPPSPAQPSSTGAAASPATAATLPVGTGQNASSVGAQLMGASSQPSEAMAPRTGPAQGGQVAPCQPTGVPPATVGGVVQPCLGPAGAGQPQSVPPPQMGGSGPLSAVPGGPHAVVPGVPNVPAAVPAPSVPSVSTTSVTMPNVPAPLAQSQQLSSHTPVSRSSSIIQHVGLPLAPGTHSAPTSLPQSDLSQFQTQTQPLVGQVDDTRRKSEPLPQPPLSLIAENKPVVKPPVADSLANPLQLTPMNSLATSVFSIAIPVDGDEDRNPSTAFYQAFHLNTLKESKSLWDSASGGGVVAIDNKIEQAMDLVKSHLMYAVREEVEVLKEQIKELVERNSLLERENALLKSLSSNDQLSQLPTQQANPGSTSQQQAVIAQPPQPTQPPQQPNVSSA

SEQ ID NO: 15806 - protein, 134 aa, Homo Sapiens
MNTEMYQTPMEVAVYQLHNFSISFFSSLLGGDVVSVKLDNSASGASVVAIDNKIEQAMDLVKNHLMYAVREEVEILKEQIRELVEKNSQLERENTLLKTLASPEQLEKFQSCLSPEEPAPESPQVPEAPGGSAV

SEQ ID NO: 15807 - protein, 395 aa, Homo Sapiens; identical to SEQ ID NO: 13764

SEQ ID NO: 15808 - protein, 1077 aa, Homo Sapiens
MPRRKQQAPRRSAAYVPEEELKAAEIDEEHVEDDGLSLDIQESEYMCNEETEIKEAQSYQNSPVSSATNQDAGYGSPFSESSDQLAHFKGSSSREEKEDPQCPDSVSYPQDSLAQIKAVYANLFSESCWSSLALDLKKSGSTTSTNDASQKESSAPTPTPPTCPVSTTGPTTSTPSTSCSSSTSHSSTTSTSSSSGYDWHQAALAKTLQQTSSYGLLPEPSLFSTVQLYRQNNKLYGSVFTGASKFRCKDCSAAYDTLVELTVHMNETGHYRDDNRDKDSEKTKRWSKPRKRSLMEMEGKEDAQKVLKCMYCGHSFESLQDLSVHMIKTKHYQKVPLKEPVPAITKLVPSTKKRALQDLAPPCSPEPAGMAAEVALSESAKDQKAANPYVTPNNRYGYQNGASYTWQFEARKAQILKCMECGSSHDTLQQLTAHMMVTGHFLKVTTSASKKGKQLVLDPVVEEKIQSIPLPPTTHTRLPASSIKKQPDSPAGSTTSEEKKEPEKEKPPVAGDAEKIKEESEDSLEKFEPSTLYPYLREEDLDDSPKGGLDILKSLENTVSTAISKAQNGAPSWGGYPSIHAAYQLPGTVKPLPAAVQSVQVQPSYAGGVKSLSSAEHNALLHSPGSLTPPPHKSNVSAMEELVEKVTGKVNIKKEERPPEKEKSSLAKAASPIAKENKDFPKTEEVSGKPQKKGPEAETGKAKKEGPLDVHTPNGTEPLKAKVTNGCNNLGIIMDHSPEPSFINPLSALQSIMNTHLGKVSKPVSPSLDPLAMLYKISNSMLDKPVYPATPVKQADAIDRYYYENSDQPIDLTKSKNKPLVSSVADSVASPLRESALMDISDMVKNLTGRLTPKSSTPSTVSEKSDADGSSFEEALDELSPVHKRKGRQSNWNPQHLLILQAQFASSLRETTEGKYIMSDLGPQERVHISKFTGLSMTTISHWLANVKYQLRRTGGTKFLKNLDTGHPVFFCNDCASQFRTASTYISHLETHLGFSLKDLSKLPLNQIQEQQNVSKVLTNKTLGPLGATEEDLGSTFQCKLCNRTFASKHAVKLHLSKTHGKSPEDHLIYVTELEKQ

SEQ ID NO: 15809 - protein, 1034 aa, Homo Sapiens
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSYSKPRKRAFQDMDKEDAQKVLKCMFCGDSFDSLQDLSVHMIKTKHYQKVPLKEPVPTISSKMVTPAKKRVFDVNRPCSPDSTTGSFADSFSSQKNANLQLSSNNRYGYQNGASYTWQFEACKSQILKCMECGSSHDTLQQLTTHMMVTGHFLKVTSSASKKGKQLVLDPLAVEKMQSLSEAPNSDSLAPKPSSNSASDCTASTTELKKESKKERPEETSKDEKVVKSEDYEDPLQKPLDPTIKYQYLREEDLEDGSKGGGDILKSLENTVTTAINKAQNGAPSWSAYPSIHAAYQLSEGTKPPLPMGSQVLQIRPNLTNKLRPIAPKWKVMPLVSMPTHLAPYTQVKKESEDKDEAVKECGKESPHEEASSFSHSEGDSFRKSETPPEAKKTELGPLKEEEKLMKEGSEKEKPQPLEPTSALSNGCALANHAPALPCINPLSALQSVLNNHLGKATEPLRSPSCSSPSSSTISMFHKSNLNVMDKPVLSPASTRSASVSRRYLFENSDQPIDLTKSKSKKAESSQAQSCMSPPQKHALSDIADMVKVLPKATTPKPASSSRVPPMKLEMDVRRFEDVSSEVSTLHKRKGRQSNWNPQHLLILQAQFASSLFQTSEGKYLLSDLGPQERMQISKFTGLSMTTISHWLANVKYQLRKTGGTKFLKNMDKGHPIFYCSDCASQFRTPSTYISHLESHLGFQMKDMTRLSVDQQSKVEQEISRVSSAQRSPETIAAEEDTDSKFKCKLCCRTFVSKHAVKLHLSKTHSKSPEHHSQFVTDVDEE

SEQ ID NO: 15810 - protein, 1081 aa, Homo Sapiens
MPRRKQQAPRRAAAYVSEELKAAALVDEGLDPEEHTADGEPSAKYMCPEKELARACPSYQNSPAAEFSCHEMDSESHISETSDRMADFESGSIKNEEETKEVTVPLEDTTVSDSLEQMKAVYNNFLSNSYWSNLNLNLHQPSSEKNNGSSSSSSSSSSSCGSGSFDWHQSAMAKTLQQVSQSRMLPEPSLFSTVQLYRQSSKLYGSIFTGASKFRCKDCSAAYDTLVELTVHMNETGHYRDDNHETDNNNPKRWSKPRKRSLLEMEGKEDAQKVLKCMYCGHSFESLQDLSVHMIKTKHYQKVPLKEPVTPVAAKIIPATRKKASLELELPSSPDSTGGTPKATISDTNDALQKNSNPYITPNNRYGHQNGASYAWHFEARKSQILKCMECGSSHDTLQELTAHMMVTGHFIKVTNSAMKKGKPIVETPVTPTITTLLDEKVQSVPLAATTFTSPSNTPASISPKLNVEVKKEVDKEKAVTDEKPKQKDKPGEEEEKCDISSKYHYLTENDLEESPKGGLDILKSLENTVTSAINKAQNGTPSWGGYPSIHAAYQLPNMMKLSLGSSGKSTPLKPMFGNSEIVSPTKNQTLVSPPSSQTSPMPKTNFHAMEELVKKVTEKVAKVEEKMKEPDGKLSPPKRATPSPCSSEVGEPIKMEASSDGGFRSQENSPSPPRDGCKDGSPLAEPVENGKELVKPLASSLSGSTAIITDHPPEQPFVNPLSALQSVMNIHLGKAAKPSLPALDPMSMLFKMSNSLAEKAAVATPPPLQSKKADHLDRYFYHVNNDQPIDLTKGKSDKGCSLGSVLLSPTSTAPATSSSTVTTAKTSAVVSFMSNSPLRENALSDISDMLKNLTESHTSKSSTPSSISEKSDIDGATLEEAEESTPAQKRKGRQSNWNPQHLLILQAQFAASLRQTSEGKYIMSDLSPQERMHISRFTGLSMTTISHWLANVKYQLRRTGGTKFLKNLDTGHPVFFCNDCASQIRTPSTYISHLESHLGFRLRDLSKLSTEQINSQIAQTKSPSEKMVTSSPEEDLGTSYQCKLCNRTFASKHAVKLHLSKTHGKSPEDHLLYVSELEKQ

SEQ ID NO: 15811 - protein, 371 aa, Homo Sapiens; identical to SEQ ID NO: 15392

SEQ ID NO: 15812 - protein, 905 aa, Homo Sapiens
MEGESSRFEIHTPVSDKKKKKCSIHKERPQKHSHEIFRDSSLVNEQSQITRRKKRKKDFQHLISSPLKKSRICDETANATSTLKKRKKRRYSALEVDEEAGVTVVLVDKENINNTPKHFRKDVDVVCVDMSIEQKLPRKPKTDKFQVLAKSHAHKSEALHSKVREKKNKKHQRKAASWESQRARDTLPQSESHQEESWLSVGPGGEITELPASAHKNKSKKKKKKSSNREYETLAMPEGSQAGREAGTDMQESQPTVGLDDETPQLLGPTHKKKSKKKKKKKSNHQEFEALAMPEGSQVGSEVGADMQESRPAVGLHGETAGIPAPAYKNKSKKKKKKSNHQEFEAVAMPESLESAYPEGSQVGSEVGTVEGSTALKGFKESNSTKKKSKKRKLTSVKRARVSGDDFSVPSKNSESTLFDSVEGDGAMMEEGVKSRPRQKKTQACLASKHVQEAPRLEPANEEHNVETAEDSEIRYLSADSGDADDSDADLGSAVKQLQEFIPNIKDRATSTIKRMYRDDLERFKEFKAQGVAIKFGKFSVKENKQLEKNVEDFLALTGIESADKLLYTDRYPEEKSVITNLKRRYSFRLHIGRNIARPWKLIYYRAKKMFDVNNYKGRYSEGDTEKLKMYHSLLGNDWKTIGEMVARSSLSVALKFSQISSQRNRGAWSKSETRKLIKAVEEVILKKMSPQELKEVDSKLQENPESCLSIVREKLYKGISWVEVEAKVQTRNWMQCKSKWTEILTKRMTNGRRIYYGMNALRAKVSLIERLYEINVEDTNEIDWEDLASAIGDVPPSYVQTKFSRLKAVYVPFWQKKTFPEIIDYLYETTLPLLKEKLEKMMEKKGTKIQTPAAPKQVFPFRDIFYYEDDSEGEDIEKESEGQAPCMAHACNSSTLGGQGRWII

SEQ ID NO: 15813 - protein, 373 aa, Homo Sapiens; identical to SEQ ID NO: 14989

SEQ ID NO: 15814 - protein, 1162 aa, Homo Sapiens
MEEVRCPEHGTFCFLKTGVRDGPNKGKSFYVCRADTCSFVRATDIPVSHCLLHEDFVVELQGLLLPQDKKEYRLFFRCIRSKAEGKRWCGSIPWQDPDSKEHSVSNKSQHASETFHHSSNWLRNPFKVLDKNQEPALWKQLIKGEGEEKKADKKQREKGDQLFDQKKEQKPEMMEKDLSSGLVPKKKQSVVQEKKQEEGAEIQCEAETGGTHKRDFSEIKSQQCQGNELTRPSASSQEKSSGKSQDVQRESEPLREKVTQLLPQNVHSHNSISKPQKGGPLNKEYTNWEAKETKAKDGPSIQATQKSLPQGHFQERPETHSVPAPGGPAAQAAPAAPGLSLGEGREAATSSDDEEEDDVVFVSSKPGSPLLFDSTLDLETKENLQFPDRSVQRKVSPASGVSKKVEPSDPVARRVYLTTQLKQKKSTLASVNIQALPDKGQKLIKQIQELEEVLSGLTLSPEQGTNEKSNSQVPQQSHFTKTTTGPPHLVPPQPLPRRGTQPVGSLELKSACQVTAGGSSQCYRGHTNQDHVHAVWKITSEAIGQLHRSLESCPGETVVAEDPAGLKVPLLLHQKQALAWLLWRESQKPQGGILADDMGLGKTLTMIALILTQKNQEKKEEKEKSTALTWLSKDDSCDFTSHGTLIICPASLIHHWKNEVEKRVNSNKLRVYLYHGPNRDSRARVLSTYDIVITTYSLVAKEIPTNKQEAEIPGANLNVEGTSTPLLRIAWARIILDEAHNVKNPRVQTSIAVCKLQACARWAVTGTPIQNNLLDMYSLLKFLRCSPFDEFNLWRSQVDNGSKKGGERLSILTKSLLLRRTKDQLDSTGRPLVILPQRKFQLHHLKLSEDEETVYNVFFARSRSALQSYLKRHESRGNQSGRSPNNPFSRVALEFGSEEPRHSEAADSPRSSTVHILSQLLRLRQCCCHLSLLKSALDPMELKGEGLVLSLEEQLSALTLSELRDSEPSSTVSLNGTFFKMELFEGMRESTKISSLLAELEAIQRNSASQKSVIVSQWTNMLKVVALHLKKHGLTYATIDGSVNPKQRMDLVEAFNHSRGPQVMLISLLAGGVGLNLTGGNHLFLLDMHWNPSLEDQACDRIYRVGQQKDVVIHRFVCEGTVEEKILQLQEKKKDLAKQVLSGSGESVTKLTLADLRVLFGI

SEQ ID NO: 15815 - protein, 506 aa, Homo Sapiens
MTSKPHSDWIPYSVLDDEGRNLRQQKLDRQRALLEQKQKKKRQEPLMVQANADGRPRSRRARQSEEQAPLVESYLSSSGSTSYQVQEADSLASVQLGATRPTAPASAKRTKAAATAGGQGGAARKEKKGKHKGTSGPAALAEDKSEAQGPVQILTVGQSDHAQDAGETAAGGGERPSGQDLRATMQRKGISSSMSFDEDEEDEEENSSSSSQLNSNTRPSSATSRKSVREAASAPSPTAPEQPVDVEVQDLEEFALRPAPQGITIKCRITRDKKGMDRGMYPTYFLHLDREDGKKVFLLAGRKRKKSKTSNYLISVDPTDLSRGGDSYIGKLRSNLMGTKFTVYDNGVNPQKASSSTLESGTLRQELAAVCYETNVLGFKGPRKMSVIVPGMNMVHERVSIRPRNEHETLLARWQNKNTESIIELQNKTPVWNDDTQSYVLNFHGRVTQASVKNFQIIHGNDPDYIVMQFGRVAEDVFTMDYNYPLCALQAFAIALSSFDSKLACE

SEQ ID NO: 15816 - protein, 202 aa, Homo Sapiens
MMQDVSSSPVSPADDSLSNSEEEPDRQQPPSGKRGGRKRRSSRRSAGGGAGPGGAAGGGVGGGDEPGSPAQGKRGKKSAGCGGGGGAGGGGGSSSGGGSPQSYEELQTQRVMANVRERQRTQSLNEAFAALRKIIPTLPSDKLSKIQTLKLAARYIDFLYQVLQSDELDSKMASCSYVAHERLSYAFSVWRMEGAWSMSASH

SEQ ID NO: 15817 - protein, 160 aa, Homo Sapiens
MEEGSSSPVSPVDSLGTSEEELERQPKRFGRKRRYSKKSSEDGSPTPGKRGKKGSPSAQSFEELQSQRILANVRERQRTQSLNEAFAALRKIIPTLPSDKLSKIQTLKLAARYIDFLYQVLQSDEMDNKMTSCSYVAHERLSYAFSVWRMEGAWSMSASH

SEQ ID NO: 15818 - protein, 540 aa, Homo Sapiens
MAWVLKMDEVIESGLVHDFDASLSGIGQELGAGAYSMSDVLALPIFKQEDSSLPLDGETEHPPFQYVMCAATSPAVKLHDETLTYLNQGQSYEIRMLDNRKMGDMPEINGKLVKSIIRVVFHDRRLQYTEHQQLEGWKWNRPGDRLLDLDIPMSVGIIDTRTNPSQLNAVEFLWDPAKRTSAFIQVHCISTEFTPRKHGGEKGVPFRIQVDTFKQNENGEYTDHLHSASCQIKVFKPKGADRKQKTDREKMEKRTAHEKEKYQPSYDTTILTEMRLEPIIEDAVEHEQKKSSKRTLPADYGDSLAKRGSCSPWPDAPTAYVNNSPSPAPTFTSPQQSTCSVPDSNSSSPNHQGDGASQTSGEQIQPSATIQETQQWLLKNRFSSYTRLFSNFSGADLLKLTKEDLVQICGAADGIRLYNSLKSRSVRPRLTIYVCREQPSSTVLQGQQQAASSASENGSGAPYVYHAIYLEEMIASEVARKLALVFNIPLHQINQVYRQGPTGIHILVSDQMVQNFQDESCFLFSTVKAESSDGIHIILK

SEQ ID NO: 15819 - protein, 764 aa, Homo Sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDATTKEVKDSLGKQWSQLSDKKRLKWIHKALEQRKEYEEIMRDYIQKHPELNISEEGITKSTLTKAERQLKDKFDGRPTKPPPNSYSLYCAELMANMKDVPSTERMVLCSQQWKLLSQKEKDAYHKKCDQKKKDYEVELLRFLESLPEEEQQRVLGEEKMLNINKKQATSPASKKPAQEGGKGGSEKPKRPVSAMFIFSEEKRRQLQEERPELSESELTRLLARMWNDLSEKKKAKYKAREAALKAQSERKPGGEREERGKLPESPKRAEEIWQQSVIGDYLARFKNDRVKALKAMEMTWNNMEKKEKLMWIKKAAEDQKRYERELSEMRAPPAATNSSKKMKFQGEPKKPPMNGYQKFSQELLSNGELNHLPLKERMVEIGSRWQRISQSQKEHYKKLAEEQQKQYKVHLDLWVKSLSPQDRAAYKEYISNKRKSMTKLRGPNPKSSRTTLQSKSESEEDDEEDEDDEDEDEEEEDDENGDSSEDGGDSSESSSEDESEDGDENEEDDEDEDDDEDDDEDEDNESEGSSSSSSSSGDSSDSDSN

SEQ ID NO: 15820 - protein, 393 aa, Homo Sapiens
MALPRSQGHWSNKDILRLLECMENNRPSDDNSTFSSTQSHMDWGKVAFKNFSGEMCRLKWLEISCNLRKFGTLKELVLEAKKCVKKMNKSQKYRNGPDFPKRPLTAYNRFFKESWPQYSQMYPGMRSQELTKILSKKYRELPEQMKQKYIQDFRKEKQEFEEKLARFREEHPDLVQKAKKSSVSKRTQNKVQKKFQKNIEEVRSLPKTDRFFKKVKFHGEPQKPPMNGYHKFHQDSWSSKEMQHLSVRERMVEIGRRWQRIPQSQKDHFKSQAEELQKQYKVKLDLWLKTLSPENYAAYKESTYAKGKNMAMTGGPDPRLKQADPQSSSAKGLQEGFGEGQGLQAAGTDSSQTIWVNCHVSMEPEENRKKDREKEESSNSSDCSSGEEIEVDV

SEQ ID NO: 15821 - protein, 400 aa, Homo Sapiens
MPAKDIKVALPRSQGHWSNADILRLLECMENNLPYDDNGTFSSTQSHMDWGKVAFKNFSGEMCRLKWLEISCSLRKFSTLKKLVLEAKKCVKNTNKSQKGRNHPDFPKRLLTAYIRFFKENWPQYSQMYPGMRSQEVTKILSKKYKELPEQMKQKHIQDFRKEKQEFEEKLARFREEHPDLDQKGKKSDICKRVQTKVQKKVQKNIEEVRSLPKTDQFFKKVKFHGEPQKPPMNGYQKFHQDSWSSKELQHLSLRERMVEIGRRWQRIPQSQKDHYKSQAELLQKEYKVELDLWLKTLSPEDYAAYKESTYAKGKNMAMMGGPAPSLKQTDPQSSSAKGLQEGFGEGQGLQAAGTEASQTIWVNCQVSMEPEDNRKKDGEEEESSNSLDCSSGEDMEVDV

SEQ ID NO: 15822 - protein, 531 aa, Homo Sapiens
MMDGRLLEHPHAQFGGSLGGVVGFPYPLGHHHVYELAGHQLQSAAAAASVPFSIDGLLGGSCAAAASVVNPTPLLPAACGVGGDGQPFKLSDSGDPDKESPGCKRRRTRTNFTGWQLEELEKAFNESHYPDVFMREALALRLDLVESRVQVWFQNRRAKWRKKENTKKGPGRPAHNSHPTTCSGEPMDPEEIARKELEKMEKKKRKHEKKLLKSQGRHLHSPGGLSLHSAPSSDSDSGGGGLSPEPPEPPPPAAKGPGAHASGAAGTAPAPPGEPPAPGTCDPAFYPSQRSGAGPQPRPGRPADKDAASCGPGAAVAAVERGAAGLPKASPFSVESLLSDSPPRRKAASNAAAAAAAGLDFAPGLPCAPRTLIGKGHFLLYPITQPLGFLVPQAALKGGAGLEPAPKDAPPAPAVPPAPPAQASFGAFSGPGGAPDSAFARRSPDAVASPGAPAPAPAPFRDLASAAATEGGGGDCADAGTAGPAPPPPAPSPRPGPRPPSPAEEPATCGVPEPGAAAGPSPPEGEELDMD

SEQ ID NO: 15823 - protein, 810 aa, Homo Sapiens
MSKGPGPGGSAASSAPPAATAQVLQAQPEKPQHYTYLKEFRTEQCPLFVQHKCTQHRPYTCFHWHFVNQRRRRSIRRRDGTFNYSPDVYCTKYDEATGLCPEGDECPFLHRTTGDTERRYHLRYYKTGICIHETDSKGNCTKNGLHCAFAHGPHDLRSPVYDIRELQAMEALQNGQTTVEGSIEGQSAGAASHAMIEKILSEEPRWQETAYVLGNYKTEPCKKPPRLCRQGYACPYYHNSKDRRRSPRKHKYRSSPCPNVKHGDEWGDPGKCENGDACQYCHTRTEQQFHPEIYKSTKCNDMQQSGSCPRGPFCAFAHVEQPPLSDDLQPSSAVSSPTQPGPVLYMPSAAGDSVPVSPSSPHAPDLSALLCRNSSLGSPSNLCGSPPGSIRKPPNLEGIVFPGESGLAPGSYKKAPGFEREDQVGAEYLKNFKCQAKLKPHSLEPRSQEQPLLQPKQDMLGILPAGSPLTSSISSSITSSLAATPPSPVGTSSVPGMNANALPFYPTSDTVESVIESALDDLDLNEFGVAALEKTFDNSTVPHPGSITIGGSLLQSSAPVNIPGSLGSSASFHSASPSPPVSLSSHFLQQPQGHLSQSENTFLGTSASHGSLGLNGMNSSIWEHFASGSFSPGTSPAFLSGPGAAELARLRQELDEANSTIKQWEESWKQAKQACDAWKKEAEEAGERASAAGAECELAREQRDALEVQVKKLQEELERLHAGPEPQALPAFSDLEALSLSTLYSLQKQLRAHLEQVDKAVFHMQSVKCLKCQEQKRAVLPCQHAALCELCAEGSECPICQPGRAHTLQS

SEQ ID NO: 15824 - protein, 680 aa, Homo Sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPESTKCNDMRQTGYCPRGPFCAFAHVEKSLGMVNEWGCHDLHLTSPSSTGSGQPGNAKRRDSPAEGGPRGSEQDSKQNHLAVFAAVHPPAPSVSSSVASSLASSAGSGSSSPTALPAPPARALPLGPASSTVEAVLGSALDLHLSNVNIASLEKDLEEQDGHDLGAAGPRSLAGSAPVAIPGSLPRAPSLHSPSSASTSPLGSLSQPLPGPVGSSAMTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVIFQLRAKQCVACRERAHGAVLRPCQHHILCEPCAATAPECPYCKGQPLQW

SEQ ID NO: 15825 - protein, 310 aa, Homo Sapiens
MKGQQKTAETEEGTVQIQEGAVATGEDPTSVAIASIQSAATFPDPNVKYVFRTENGGQVMYRVIQVSEGQLDGQTEGTGAISGYPATQSMTQAVIQGAFTSDDAVDTEGTAAETHYTYFPSTAVGDGAGGTTSGSTAAVVTTQGSEALLGQATPPGTGQFFVMMSPQEVLQGGSQRSIAPRTHPYSPKSEAPRTTRDEKRRAQHNEVERRRRDKINNWIVQLSKIIPDCSMESTKSGQSKGGILSKACDYIQELRQSNHRLSEELQGLDQLQLDNDVLRQQVEDLKNKNLLLRAQLRHHGLEVVIKNDSN

SEQ ID NO: 15826 - protein, 346 aa, Homo Sapiens
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWIVQLSKIIPDCNADNSKTGASKGGILSKACDYIRELRQTNQRMQETFKEAERLQMDNELLRQQIEELKNENALLRAQLQQHNLEMVGEGTRQ

SEQ ID NO: 15827 - protein, 2245 aa, Homo Sapiens
MPEMTENETPTKKQHRKKNRETHNAVERHRKKKINAGINRIGELIPCSPALKQSKNMILDQAFKYITELKRQNDELLLNGGNNEQAEEIKKLRKQLEEIQKENGRYIELLKANDICLYDDPTIHWKGNLKNSKVSVVIPSDQVQKKIIVYSNGNQPGGNSQGTAVQGITFNVSHNLQKQTANVVPVQRTCNLVTPVSISGVYPSENKPWHQTTVPALATNQPVPLCLPAAISAQSILELPTSESESNVLGATSGSLIAVSIESEPHQHHSLHTCLNDQNSSENKNGQENPKVLKKMTPCVTNIPHSSSATATKVHHGNKSCLSIQDFRGDFQNTFVVSVTTTVCSQPPRTAGDSSPMSISKSADLTSTATVVASSAPGVGKATIPISTLSGNPLDNGWTLSCSLPSSSVSTSDLKNINSLTRISSAGNTQTTWTTLQLAGNTIQPLSQTPSSAVTPVLNESGTSPTTSNHSRYVATDINLNNSFPADGQPVEQVVVTLPSCPSLPMQPLIAQPQVKSQPPKNILPLNSAMQVIQMAQPVGSAVNSAPTNQNVIILQPPSTTPCPTVMRAEVSNQTVGQQIVIIQAANQNPLPLLPAPPPGSVRLPINGANTVIGSNNSVQNVPTPQTFGGKHLVHILPRPSSLSASNSTQTFSVTMSNQQPQTISLNGQLFALQPVMSSSGTTNQTPMQIIQPTTSEDPNTNVALNTFGALASLNQSISQMAGQSCVQLSISQPANSQTAANSQTTTANCVSLTTTAAPPVTTDSSATLASTYNLVSTSSMNTVACLPNMKSKRLNKKPGGRKHLAANKSACPLNSVRDVSKLDCPNTEGSAEPPCNDGLLESFPAVLPSVSVSQANSVSVSASHSLGVLSSESLIPESVSKSKSAEKSSPPSQESVTSEHFAMAAAKSKDSTPNLQQETSQDKPPSSLALSDAAKPCASANVLIPSPSDPHILVSQVPGLSSTTSTTSTDCVSEVEIIAEPCRVEQDSSDTMQTTGLLKGQGLTTLLSDLAKKKNPQKSSLSDQMDHPDFSSENPKIVDSSVNLHPKQELLLMNNDDRDPPQHHSCLPDQEVINGSLINGRQADSPMSTSSGSSRSFSVASMLPETTREDVTSNATTNTCDSCTFVEQTDIVALAARAIFDQENLEKGRVGLQADIREVASKPSEASLLEGDPPFKSQIPKESGTGQAEATPNEFNSQGSIEATMERPLEKPSCSLGIKTSNASLQDSTSQPPSITSLSVNNLIHQSSISHPLASCAGLSPTSEQTTVPATVNLTVSSSSYGSQPPGPSLMTEYSQEQLNTMTSTIPNSQIQEPLLKPSHESRKDSAKRAVQDDLLLSSAKRQKHCQPAPLRLESMSLMSRTPDTISDQTQMMVSQIPPNSSNSVVPVSNPAHGDGLTRLFPPSNNFVTPALRQTEVQCGSQPSVAEQQQTQASQHLQALQQHVPAQGVSHLHSNHLYIKQQQQQQQQQQQQQQQQQAGQLRERHHLYQMQHHVPHAESSVHSQPHNVHQQRTLQQEVQMQKKRNLVQGTQTSQLSLQPKHHGTDQSRSKTGQPHPHHQQMQQQMQQHFGSSQTEKSCENPSTSRNHHNHPQNHLNQDIMHQQQDVGSRQQGSGVSSEHVSGHNPMQRLLTSRGLEQQMVSQPSIVTRSSDMTCTPHRPERNRVSSYSAEALIGKTSSNSEQRMGISIQGSRVSDQLEMRSYLDVPRNKSLAIHNMQGRVDHTVASDIRLSDCQTFKPSGASQQPQSNFEVQSSRNNEIGNPVSSLRSMQSQAFRISQNTGPPPIDRQKRLSYPPVQSIPTGNGIPSRDSENTCHQSFMQSLLAPHLSDQVIGSQRSLSEHQRNTQCGPSSAIEYNCPPTHENVHIRRESESQNRESCDMSLGAINTRNSTLNIPFSSSSSSGDIQGRNTSPNVSVQKSNPMRITESHATKGHMNPPVTTNMHGVARPALPHPSVSHGNGDQGPAVRQANSSVPQRSRHPLQDSSGSKIRQPERNRSGNQRQSTVFDPSLPHLPLSTGGSMILGRQQPATEKRGSIVRFMPDSPQVPNDNSGPDQHTLSQNFGFSFIPEGGMNPPINANASFIPQVTQPSATRTPALIPVDPQNTLPSFYPPYSPAHPTLSNDISIPYFPNQMFSNPSTEKVNSGSLNNRFGSILSPPRPVGFAQPSFPLLPDMPPMHMTNSHLSNFNMTSLFPEIATVLPDGSAMSPLLTIANSSASDSSKQSSNRPAHNISHILGHDCSSAV

SEQ ID NO: 15828 - protein, 341 aa, Homo Sapiens
MLLRPRRPPPLAPPAPPSPASPDPEPRTPGDAPGTPPRRPASPSALGELGLPVSPGSAQRTPWSARETELLLGTLLQPAVWRALLLDRRQALPTYRRVSAALAQQQVRRTPAQCRRRYKFLKDKFREAHGQPPGPFDEQIRKLMGLLGDNGRKRPRRRSPGSGRPQRARRPVPNAHAPAPSEPDATPLPTARDRDADPTWTLRFSPSPPKSADASPAPGSPPAPAPTALATCIPEDRAPVRGPGSPPPPPAREDPDSPPGRPEDCAPPPAAPPSLNTALLQTLGHLGDIANILGPLRDQLLTLNQHVEQLRGAFDQTVSLAVGFILGSAAAERGVLRDPCQ

SEQ ID NO: 15829 - protein, 334 aa, Homo Sapiens
MFGKPDKMDVRCHSDAEAARVSKNAHKESRESKGAEGNLPAAFLKEPQGAFSASGAAEDCNKSKSNSAADPDYCRRILVRDAKGSIREIILPKGLDLDRPKRTRTSFTAEQLYRLEMEFQRCQYVVGRERTELARQLNLSETQVKVWFQNRRTKQKKDQGKDSELRSVVSETAATCSVLRLLEQGRLLSPPGLPALLPPCATGALGSALRGPSLPALGAGAAAGSAAAAAAAAPGPAGAASPHPPAVGGAPGPGPAGPGGLHAGAPAAGHSLFSLPVPSLLGSVASRLSSAPLTMAGSLAGNLQELSARYLSSSAFEPYSRTNNKEGAEKKALD

SEQ ID NO: 15830 - protein, 290 aa, Homo Sapiens
MGDGGAERDRGPARRAESGGGGGRCGDRSGAGDLRADGGGHSPTEVAGTSASSPAGSRESGADSDGQPGPGEADHCRRILVRDAKGTIREIVLPKGLDLDRPKRTRTSFTAEQLYRLEMEFQRCQYVVGRERTELARQLNLSETQVKVWFQNRRTKQKKDQSRDLEKRASSSASEAFATSNILRLLEQGRLLSVPRAPSLLALTPSLPGLPASHRGTSLGDPRNSSPRLNPLSSASASPPLPPPLPAVCFSSAPLLDLPAGYELGSSAFEPYSWLERKVGSASSCKKANT

SEQ ID NO: 15831 - protein, 427 aa, Homo Sapiens
MEAMAASTSLPDPGDFDRNVPRICGVCGDRATGFHFNAMTCEGCKGFFRRSMKRKALFTCPFNGDCRITKDNRRHCQACRLKRCVDIGMMKEFILTDEEVQRKREMILKRKEEEALKDSLRPKLSEEQQRIIAILLDAHHKTYDPTYSDFCQFRPPVRVNDGGGSHPSRPNSRHTPSFSGDSSSSCSDHCITSSDMMDSSSFSNLDLSEEDSDDPSVTLELSQLSMLPHLADLVSYSIQKVIGFAKMIPGFRDLTSEDQIVLLKSSAIEVIMLRSNESFTMDDMSWTCGNQDYKYRVSDVTKAGHSLELIEPLIKFQVGLKKLNLHEEEHVLLMAICIVSPDRPGVQDAALIEAIQDRLSNTLQTYIRCRHPPPGSHLLYAKMIQKLADLRSLNEEHSKQYRCLSFQPECSMKLTPLVLEVFGNEIS

SEQ ID NO: 15832 - protein, 258 aa, Homo Sapiens
MRLSSSPPRGPQQLSSFGSVDWLSQSSCSGPTHTPRPADFSLGSLPGPGQTSGAREPPQAVSIKEAAGSSNLPAPERTMAGLSKEPNTLRAPRVRTAFTMEQVRTLEGVFQHHQYLSPLERKRLAREMQLSEVQIKTWFQNRRMKHKRQMQDPQLHSPFSGSLHAPPAFYSTSSGLANGLQLLCPWAPLSGPQALMLPPGSFWGLCQVAQEALASAGASCCGQPLASHPPTPGRPSLGPALSTGPRGLCAMPQTGDAF

SEQ ID NO: 15833 - protein, 521 aa, Homo Sapiens
MEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVHSTERPFKCQTCTAAFATKDRLRTHMVRHEGKVSCNICGKLLSAAYITSHLKTHGQSQSINCNTCKQGISKTCMSEETSNQKQQQQQQQQQQQQQQQQQQHVTSWPGKQVETLRLWEEAVKARKKEAANLCQTSTAATTPVTLTTPFSITSSVSSGTMSNPVTVAAAMSMRSPVNVSSAVNITSPMNIGHPVTITSPLSMTSPLTLTTPVNLPTPVTAPVNIAHPVTITSPMNLPTPMTLAAPLNIAMRPVESMPFLPQALPTSPPW

SEQ ID NO: 15834 - protein, 365 aa, Homo Sapiens
MTGRDSLSDGRTSSRALVPGGSPRGSRPRGFAITDLLGLEAELPAPAGPGQGSGCEGPAVAPCPGPGLDGSSLARGALPLGLGLLCGFGTQPPAAARAPCLLLADVPFLPPRGPEPAAPLAPSRPPPALGRQKRSDSVSTSDEDSQSEDRNDLKASPTLGKRKKRRHRTVFTAHQLEELEKAFSEAHYPDVYAREMLAVKTELPEDRIQVWFQNRRAKWRKREKRWGGSSVMAEYGLYGAMVRHCIPLPDSVLNSAEGGLLGSCAPWLLGMHKKSMGMIRKPGSEDKLAGLWGSDHFKEGSSQSESGSQRGSDKVSPENGLEDVAIDLSSSARQETKKVHPGAGAQGGSNSTALEGPQPGKVGAT

SEQ ID NO: 15835 - protein, 361 aa, Homo Sapiens
MTGKAGEALSKPKSETVAKSTSGGAPARCTGFGIQEILGLNKEPPSSHPRAALDGLAPGHLLAARSVLSPAGVGGMGLLGPGGLPGFYTQPTFLEVLSDPQSVHLQPLGRASGPLDTSQTASSDSEDVSSSDRKMSKSALNQTKKRKKRRHRTIFTSYQLEELEKAFNEAHYPDVYAREMLAMKTELPEDRIQVWFQNRRAKWRKREKCWGRSSVMAEYGLYGAMVRHSIPLPESILKSAKDGIMDSCAPWLLGMHKKSLEAAAESGRKPEGERQALPKLDKMEQDERGPDAQAAISQEELRENSIAVLRAKAQEHSTKVLGTVSGPDSLARSTEKPEEEEAMDEDRPAERLSPPQLEDMA

SEQ ID NO: 15836 - protein, 1129 aa, Homo Sapiens
MPATRKPMRYGHTEGHTEVCFDDSGSFIVTCGSDGDVRIWEDLDDDDPKFINVGEKAYSCALKSGKLVTAVSNNTIQVHTFPEGVPDGILTRFTTNANHVVFNGDGTKIAAGSSDFLVKIVDVMDSSQQKTFRGHDAPVLSLSFDPKDIFLASASCDGSVRVWQISDQTCAISWPLLQKCNDVINAKSICRLAWQPKSGKLLAIPVEKSVKLYRRESWSHQFDLSDNFISQTLNIVTWSPCGQYLAAGSINGLIIVWNVETKDCMERVKHEKGYAICGLAWHPTCGRISYTDAEGNLGLLENVCDPSGKTSSSKVSSRVEKDYNDLFDGDDMSNAGDFLNDNAVEIPSFSKGIINDDEDDEDLMMASGRPRQRSHILEDDENSVDISMLKTGSSLLKEEEEDGQEGSIHNLPLVTSQRPFYDGPMPTPRQKPFQSGSTPLHLTHRFMVWNSIGIIRCYNDEQDNAIDVEFHDTSIHHATHLSNTLNYTIADLSHEAILLACESTDELASKLHCLHFSSWDSSKEWIIDLPQNEDIEAICLGQGWAAAATSALLLRLFTIGGVQKEVFSLAGPVVSMAGHGEQLFIVYHRGTGFDGDQCLGVQLLELGKKKKQILHGDPLPLTRKSYLAWIGFSAEGTPCYVDSEGIVRMLNRGLGNTWTPICNTREHCKGKSDHYWVVGIHENPQQLRCIPCKGSRFPPTLPRPAVAILSFKLPYCQIATEKGQMEEQFWRSVIFHNHLDYLAKNGYEYEESTKNQATKEQQELLMKMLALSCKLEREFRCVELADLMTQNAVNLAIKYASRSRKLILAQKLSELAVEKAAELTATQVEEEEEEEDFRKKLNAGYSNTATEWSQPRFRNQVEEDAEDSGEADDEEKPEIHKPGQNSFSKSTNSSDVSAKSGAVTFSSQGRVNPFKVSASSKEPAMSMNSARSTNILDNMGKSSKKSTALSRTTNNEKSPIIKPLIPKPKPKQASAASYFQKRNSQTNKTEEVKEENLKNVLSETPAICPPQNTENQRPKTGFQMWLEENRSNILSDNPDFSDEADIIKEGMIRFRVLSTEERKVWANKAKGETASEGTEAKKRKRVVDESDETENQEEKAKENLNLSKKQKPLDFSTNQKLSAFAFKQE

SEQ ID NO: 15837 - protein, 1365 aa, Homo Sapiens
MEFSIKQSPLSVQSVVKCIKMKQAPEILGSANGKTPSCEVNRECSVFLSKAQLSSSLQEGVMQKFNGHDALPFIPADKLKDLTSRVFNGEPGAHDAKLRFESQEMKGIGTPPNTTPIKNGSPEIKLKITKTYMNGKPLFESSICGDSAADVSQSEENGQKPENKARRNRKRSIKYDSLLEQGLVEAALVSKISSPSDKKIPAKKESCPNTGRDKDHLLKYNVGDLVWSKVSGYPWWPCMVSADPLLHSYTKLKGQKKSARQYHVQFFGDAPERAWIFEKSLVAFEGEGQFEKLCQESAKQAPTKAEKIKLLKPISGKLRAQWEMGIVQAEEAASMSVEERKAKFTFLYVGDQLHLNPQVAKEAGIAAESLGEMAESSGVSEEAAENPKSVREECIPMKRRRRAKLCSSAETLESHPDIGKSTPQKTAEADPRRGVGSPPGRKKTTVSMPRSRKGDAASQFLVFCQKHRDEVVAEHPDASGEEIEELLRSQWSLLSEKQRARYNTKFALVAPVQAEEDSGNVNGKKRNHTKRIQDPTEDAEAEDTPRKRLRTDKHSLRKRDTITDKTARTSSYKAMEAASSLKSQAATKNLSDACKPLKKRNRASTAASSALGFSKSSSPSASLTENEVSDSPGDEPSESPYESADETQTEVSVSSKKSERGVTAKKEYVCQLCEKPGSLLLCEGPCCGAFHLACLGLSRRPEGRFTCSECASGIHSCFVCKESKTDVKRCVVTQCGKFYHEACVKKYPLTVFESRGFRCPLHSCVSCHASNPSNPRPSKGKMMRCVRCPVAYHSGDACLAAGCSVIASNSIICTAHFTARKGKRHHAHVNVSWCFVCSKGGSLLCCESCPAAFHPDCLNIEMPDGSWFCNDCRAGKKLHFQDIIWVKLGNYRWWPAEVCHPKNVPPNIQKMKHEIGEFPVFFFGSKDYYWTHQARVFPYMEGDRGSRYQGVRGIGRVFKNALQEAEARFREIKLQREARETQESERKPPPYKHIKVNKPYGKVQIYTADISEIPKCNCKPTDENPCGFDSECLNRMLMFECHPQVCPAGEFCQNQCFTKRQYPETKIIKTDGKGWGLVAKRDIRKGEFVNEYVGELIDEEECMARIKHAHENDITHFYMLTIDKDRIIDAGPKGNYSRFMNHSCQPNCETLKWTVNGDTRVGLFAVCDIPAGTELTFNYNLDCLGNEKTVCRCGASNCSGFLGDRPKTSTTLSSEEKGKKTKKKTRRRRAKGEGKRQSEDECFRCGDGGQLVLCDRKFCTKAYHLSCLGLGKRPFGKWECPWHHCDVCGKPSTSFCHLCPNSFCKEHQDGTAFSCTPDGRSYCCEHDLGAASVRSTKTEKPPPEPGKPKGKRRRRRGWRRVTEGK

SEQ ID NO: 15838 - protein, 1651 aa, Homo Sapiens
MEGSLAGSLAAPDRPQGPERLPGPAPRENIEGGAEAAEGEGGIFRSTRYLPVTKEGPRDILDGRGGISGTPDGRGPWEHPLVQEAGEGILSERRFEDSVIVRTMKPHAELEGSRRFLHHRGEPRLLEKHAQGRPRFDWLQDEDEQGSPQDAGLHLDLPAQPPPLAPFRRVFVPVEDTPKTLDMAVVGGREDLEDLEGLAQPSEWGLPTSASEVATQTWTVNSEASVERLQPLLPPIRTGPYLCELLEEVAEGVASPDEDEDEEPAVFPCIECSIYFKQKEHLLEHMSQHRRAPGQEPPADLAPLACGECGWAFADPTALEQHRQLHQASREKIIEEIQKLKQVPGDEGREARLQCPKCVFGTNSSRAYVQHAKLHMREPPGQTTKEPFGGSSGAGSPSPEASALLYQPYGAAVGLSACVFCGFPAPSESLLREHVRLVHAHPHWEEDGEAYEEDPASQPGTSQDAHACFPDTAVDYFGKAEPSLAPMWRENPAGYDPSLAFGPGCQQLSIRDFPLSKPLLHGTGQRPLGRLAFPSTLASTPYSLQLGRNKSTVHPQGLGERRRPWSEEEEEEEEEEDVVLTSEMDFSPENGVFSPLATPSLIPQAALELKQAFREALQAVEATQGQQQQLRGMVPIVLVAKLGPQVMAAARVPPRLQPEELGLAGAHPLDFLLLDAPLGGPLGLDTLLDGDPAMALKHEERKCPYCPDRFHNGIGLANHVRGHLNRVGVSYNVRHFISAEEVKAIERRFSFQKKKKKVANFDPGTFSLMRCDFCGAGFDTRAGLSSHARAHLRDFGITNWELTVSPINILQELLATSAAEQPPSPLGREPGGPPGSFLTSRRPRLPLTVPFPPTWAEDPGPAYGDAQSLTTCEVCGACFETRKGLSSHARSHLRQLGVAESESSGAPIDLLYELVKQKGLPDAHLGLPPGLAKKSSSLKEVVAGAPRPGLLSLAKPLDAPAVNKAIKSPPGFSAKGLGHPPSSPLLKKTPLALAGSPTPKNPEDKSPQLSLSPRPASPKAQWPQSEDEGPLNLTSGPEPARDIRCEFCGEFFENRKGLSSHARSHLRQMGVTEWYVNGSPIDTLREILKRRTQSRPGGPPNPPGPSPKALAKMMGGAGPGSSLEARSPSDLHISPLAKKLPPPPGSPLGHSPTASPPPTARKMFPGLAAPSLPKKLKPEQIRVEIKREMLPGALHGELHPSEGPWGAPREDMTPLNLSSRAEPVRDIRCEFCGEFFENRKGLSSHARSHLRQMGVTEWSVNGSPIDTLREILKKKSKPCLIKKEPPAGDLAPALAEDGPPTVAPGPVQSPLPLSPLAGRPGKPGAGPAQVPRELSLTPITGAKPSATGYLGSVAAKRPLQEDRLLPAEVKAKTYIQTELPFKAKTLHEKTSHSSTEACCELCGLYFENRKALASHARAHLRQFGVTEWCVNGSPIETLSEWIKHRPQKVGAYRSYIQGGRPFTKKFRSAGHGRDSDKRPSLGLAPGGLAVVGRSAGGEPGPEAGRAADGGERPLAASPPGTVKAEEHQRQNINKFERRQARPPDASAARGGEDTNDLQQKLEEVRQPPPRVRPVPSLVPRPPQTSLVKFVGNIYTLKCRFCEVEFQGPLSIQEEWVRHLQRHILEMNFSKADPPPEESQAPQAQTAAAEAP

SEQ ID NO: 15839 - protein, 449 aa, Homo Sapiens
MGSDVRDLNALLPAVPSLGGGGGCALPVSGAAQWAPVLDFAPPGASAYGSLGGPAPPPAPPPPPPPPPHSFIKQEPSWGGAEPHEEQCLSAFTVHFSGQFTGTAGACRYGPFGPPPPSQASSGQARMFPNAPYLPSCLESQPAIRNQGYSTVTFDGTPSYGHTPSHHAAQFPNHSFKHEDPMGQQGSLGEQQYSVPPPVYGCHTPTDSCTGSQALLLRTPYSSDNLYQMTSQLECMTWNQMNLGATLKGVAAGSSSSVKWTEGQSNHSTGYESDNHTTPILCGAQYRIHTHGVFRGIQDVRRVPGVAPTLVRSASETSEKRPFMCAYPGCNKRYFKLSHLQMHSRKHTGEKPYQCDFKDCERRFSRSDQLKRHQRRHTGVKPFQCKTCQRKFSRSDHLKTHTRTHTGKTSEKPFSCRWPSCQKKFARSDELVRHHNMHQRNMTKLQLAL

SEQ ID NO: 15840 - protein, 261 aa, Homo Sapiens
MVVVAAAPNPADGTPKVLLLSGQPASAAGAPAGQALPLMVPAQRGASPEAASGGLPQARKRQRLTHLSPEEKALRRKLKNRVAAQTARDRKKARMSELEQQVVDLEEENQKLLLENQLLREKTHGLVVENQELRQRLGMDALVAEEEAEAKGNEVRPVAGSAESAALRLRAPLQQVQAQLSPLQNISPWILAVLTLQIQSLISCWAFWTTWTQSCSSNALPQSLPAWRSSQRSTQKDPVPYQPPFLCQWGRHQPSWKPLMN

SEQ ID NO: 15841 - protein, 324 aa, Homo Sapiens
MSSEAETQQPPAAPPAAPALSAADTKPGTTGSGAGSGGPGGLTSAAPAGGDKKVIATKVLGTVKWFNVRNGYGFINRNDTKEDVFVHQTAIKKNNPRKYLRSVGDGETVEFDVVEGEKGAEAANVTGPGGVPVQGSKYAADRNHYRRYPRRRGPPRNYQQNYQNSESGEKNEGSESAPEGQAQQRRPYRRRRFPPYYMRRPYGRRPQYSNPPVQGEVMEGADNQGAGEQGRPVRQNMYRGYRPRFRRGPPRQRQPREDGNEEDKENQGDETQGQQPPQRRYRRNFNYRRRRPENPKPQDGKETKAADPPAENSSAPEAEQGGAE

SEQ ID NO: 15842 - protein, 364 aa, Homo Sapiens
MSEVEAAAGATAVPAATVPATAAGVVAVVVPVPAGEPQKGGGAGGGGGAASGPAAGTPSAPGSRTPGNPATAVSGTPAPPARSQADKPVLAIQVLGTVKWFNVRNGYGFINRNDTKEDVFVHQTAIKRNNPRKFLRSVGDGETVEFDVVEGEKGAEATNVTGPGGVPVKGSRYAPNRRKSRRFIPRPPSVAPPPMVAEIPSAGTGPGSKGERAEDSGQRPRRWCPPPFFYRRRFVRGPRPPNQQQPIEGTDRVEPKETAPLEGHQQQGDERVPPPRFRPRYRRPFRPRPRQQPTTEGGDGETKPSQGPADGSRPEPQRPRNRPYFQRRRQQAPGPQQAPGPRQPAAPETSAPVNSGDPTTTILE

SEQ ID NO: 15843 - protein, 372 aa, Homo Sapiens
MSEAGEATTTTTTTLPQAPTEAAAAAPQDPAPKSPVGSGAPQAAAPAPAAHVAGNPGGDAAPAATGTAAAASLATAAGSEDAEKKVLATKVLGTVKWFNVRNGYGFINRNDTKEDVFVHQTAIKKNNPRKYLRSVGDGETVEFDVVEGEKGAEAANVTGPDGVPVEGSRYAADRRRYRRGYYGRRRGPPRNYAGEEEEEGSGSSEGFDPPATDRQFSGARNQLRRPQYRPQYRQRRFPPYHVGQTFDRRSRVLPHPNRIQAGEIGEMKDGVPEGAQLQGPVHRNPTYRPRYRSRGPPRPRPAPAVGEAEDKENQQATSGPNQPSVRRGYRRPYNYRRRPRPPNAPSQDGKEAKAGEAPTENPAPPTQQSSAE

SEQ ID NO: 15844 - protein, 1422 aa, Homo Sapiens
MSGIKRTIKETDPDYEDVSVALPNKRHKAIENSARDAAVQKIETIIKEQFALEMKNKEHEIEVIDQRLIEARRMMDKLRACIVANYYASAGLLKVSEGSKTCDTMVFNHPAIKKFLESPSRSSSPANQRAETPSANHSESDSLSQHNDFLSDKDNNSNMDIEERLSNNMEQRPSRNTGRDTSRITGSHKTEQRNADLTDETSRLFVKKTIVVGNVSKYIPPDKREENDQSTHKWMVYVRGSRREPSINHFVKKVWFFLHPSYKPNDLVEVREPPFHLTRRGWGEFPVRVQVHFKDSQNKRIDIIHNLKLDRTYTGLQTLGAETVVDVELHRHSLGEDCIYPQSSESDISDAPPSLPLTIPAPVKASSPIKQSHEPVPDTSVEKGFPASTEAERHTPFYALPSSLERTPTKMTTSQKVTFCSHGNSAFQPIASSCKIVPQSQVPNPESPGKSFQPITMSCKIVSGSPISTPSPSPLPRTPTSTPVHVKQGTAGSVINNPYVIMDKQPGQVIGATTPSTGSPTNKISTASQVSQGTGSPVPKIHGSSFVTSTVKQEDSLFASMPPLCPIGSHPKVQSPKPITGGLGAFTKVIIKQEPGEAPHVPATGAASQSPLPQYVTVKGGHMIAVSPQKQVITPGEGIAQSAKVQPSKVVGVPVGSALPSTVKQAVAISGGQILVAKASSSVSKAVGPKQVVTQGVAKAIVSGGGGTIVAQPVQTLTKAQVTAAGPQKSGSQGSVMATLQLPATNLANLANLPPGTKLYLTTNSKNPSGKGKLLLIPQGAILRATNNANLQSGSAASGGSGAGGGGGGGGGGGSGSGGGGSTGGGGGTAGGGTQSTAGPGGISQHLTYTSYILKQTPQGTFLVGQPSPQTSGKQLTTGSVVQGTLGVSTSSAQGQQTLKVISGQKTTLFTQAAHGGQASLMKISDSTLKTVPATSQLSKPGTTMLRVAGGVITTATSPAVALSANGPAQQSEGMAPVSSSTVSSVTKTSGQQQVCVSQATVGTCKAATPTVVSATSLVPTPNPISGKATVSGLLKIHSSQSSPQQAVLTIPSQLKPLSVNTSGGVQTILMPVNKVVQSFSTSKPPAILPVAAPTPVVPSSAPAAVAKVKTEPETPGPSCLSQEGQTAVKTEESSELGNYVIKIDHLETIQQLLTAVVKKIPLITAKSEDASCFSAKSVEQYYGWNIGKRRAAEWQRAMTMRKVLQEILEKNPRFHHLTPLKTKHIAHWCRCHGYTPPDPESLRNDGDSIEDVLTQIDSEPECPSSFSSADNLCRKLEDLQQFQKREPENEEEVDILSLSEPVKINIKKEQEEKQEEVKFYLPPTPGSEFIGDVTQKIGITLQPVALHRNVYASVVEDMILKATEQLVNDILRQALAVGYQTASHNRIPKEITVSNIHQAICNIPFLDFLTNKHMGILNEDQ

SEQ ID NO: 15845 - protein, 227 aa, Homo Sapiens
MFKRMAEFGPDSGGRVKGVTIVKPIVYGNVARYFGKKREEDGHTHQWTVYVKPYRNEDMSAYVKKIQFKLHESYGNPLRVVTKPPYEITETGWGEFEIIIKIFFIDPNERPVTLYHLLKLFQSDTNAMLGKKTVVSEFYDEMIFQDPTAMMQQLLTTSRQLTLGAYKHETEFAELEVKTREKLEAAKKKTSFEIAELKERLKASRETINCLKNEIRKLEEDDQAKDI

SEQ ID NO: 15846 - protein, 414 aa, Homo Sapiens
MASGDTLYIATDGSEMPAEIVELHEIEVETIPVETIETTVVGEEEEEDDDDEDGGGGDHGGGGGHGHAGHHHHHHHHHHHPPMIALQPLVTDDPTQVHHHQEVILVQTREEVVGGDDSDGLRAEDGFEDQILIPVPAPAGGDDDYIEQTLVTVAAAGKSGGGGSSSSGGGRVKKGGGKKSGKKSYLSGGAGAAGGGGADPGNKKWEQKQVQIKTLEGEFSVTMWSSDEKKDIDHETVVEEQIIGENSPPDYSEYMTGKKLPPGGIPGIDLSDPKQLAEFARMKPRKIKEDDAPRTIACPHKGCTKMFRDNSAMRKHLHTHGPRVHVCAECGKAFVESSKLKRHQLVHTGEKPFQCTFEGCGKRFSLDFNLRTHVRIHTGDRPYVCPFDGCNKKFAQSTNLKSHILTHAKAKNNQ

SEQ ID NO: 15847 - protein, 372 aa, Homo Sapiens
MASNEDFSITQDLEIPADIVELHDINVEPLPMEDIPTESVQYEDVDGNWIYGGHNHPPLMVLQPLFTNTGYGDHDQEMLMLQTQEEVVGYCDSDNQLGNDLEDQLALPDSIEDEHFQMTLASLSASAASTSTSTQSRSKKPSKKPSGKSATSTEANPAGSSSSLGTRKWEQKQMQVKTLEGEFSVTMWSPNDNNDQGAVGEGQAENPPDYSEYLKGKKLPPGGLPGIDLSDPKQLAEFTKVKPKRSKGEPPKTVPCSYSGCEKMFRDYAAMRKHLHIHGPRVHVCAECGKAFLESSKLRRHQLVHTGEKPFQCTFEGCGKRFSLDFNLRTHLRIHTGDKPFVCPFDVCNRKFAQSTNLKTHILTHVKTKNNP

SEQ ID NO: 15848 - protein, 694 aa, Homo Sapiens
MENKSLESSQTDLKLVAHPRAKSKVWKYFGFDTNAEGCILQWKKIYCRICMAQIAYSGNTSNLSYHLEKNHPEEFCEFVKSNTEQMREAFATAFSKLKPESSQQPGQDALAVKAGHGYDSKKQQELTAAVLGLICEGLYPASIVDEPTFKVLLKTADPRYELPSRKYISTKAIPEKYGAVREVILKELAEATWCGISTDMWRSENQNRAYVTLAAHFLGLGAPNCLSMGSRCLKTFEVPEENTAETITRVLYEVFIEWGISAKVFGATTNYGKDIVKACSLLDVAVHMPCLGHTFNAGIQQAFQLPKLGALLSRCRKLVEYFQQSAVAMYMLYEKQKQQNVAHCMLVSNRVSWWGSTLAMLQRLKEQQFVIAGVLVEDSNNHHLMLEASEWATIEGLVELLQPFKQVAEMLSASRYPTISMVKPLLHMLLNTTLNIKETDSKELSMAKEVIAKELSKTYQETPEIDMFLNVATFLDPRYKRLPFLSAFERQQVENRVVEEAKGLLDKVKDGGYRPAEDKIFPVPEEPPVKKLMRTSTPPPASVINNMLAEIFCQTGGVEDQEEWHAQVVEELSNFKSQKVLGLNEDPLKWWSDRLALFPLLPKVLQKYWCVTATRVAPERLFGSAANVVSAKRNRLAPAHVDEQVFLYENARSGAEAEPEDQDEGEWGLDQEQVFSLGDGVSGGFFGIRDSSFL

SEQ ID NO: 15849 - protein, 218 aa, Homo Sapiens
MMRREDEEEEGTMMKAKGDLEMKEEEEISETGELVGPFVSAMPTPMPHNKGTRFSEAWEYFHLAPARAGHHPNQYATCRLCGRQVSRGPGVNVGTTALWKHLKSMHREELEKSGHGQAGQRQDPRPHGPQLPTGIEGNWGRLLEQVGTMALWASQREKEVLRRERAVEWRERAVEKRERALEEVERAILEMKWKVRAEKEACQREKELPAAVHPFHFV

SEQ ID NO: 15850 - protein, 234 aa, Homo Sapiens
MRSGEPACTMDQARGLDDAAARGGQCPGLGPAPTPTPPGRLGAPYSEAWGYFHLAPGRPGHPSGHWATCRLCGEQVGRGPGFHAGTSALWRHLRSAHRRELESSGAGSSPPAAPCPPPPGPAAAPEGDWARLLEQMGALAVRGSRRERELERRELAVEQGERALERRRRALQEEERAAAQARRELQAEREALQARLRDVSRREGALGWAPAAPPPLKDDPEGDRDGCVITKVLL

SEQ ID NO: 15851 - protein, 1171 aa, Homo Sapiens
MENNLKTCPKEDGDFVSDKIKFKIEEEDDDGIPPDSLERMDFKSEQEDMKQTDSGGERAGLGGTGCSCKPPGKYLSAESEDDYGALFSQYSSTLYDVAMEAVTQSLLSSRNMSSRKKSPAWKHFFISPRDSTKAICMYCVKEFSRGKNEKDLSTSCLMRHVRRAHPTVLIQENGSVSAVSSFPSPSLLLPPQPADAGDLSTILSPIKLVQKVASKIPSPDRITEESVSVVSSEEISSDMSVSEKCGREEALVGSSPHLPALHYDEPAENLAEKSLPLPKSTSGSRRRSAVWKHFYLSPLDNSKAVCIHCMNEFSRGKNGKDLGTSCLIRHMWRAHRAIVLQENGGTGIPPLYSTPPTLLPSLLPPEGELSSVSSSPVKPVRESPSASSSPDRLTEDLQSHLNPGDGLMEDVAAFSSSDDIGEASASSPEKQQADGLSPRLFESGAIFQQNKKVMKRLKSEVWHHFSLAPMDSLKAECRYCGCAISRGKKGDVGTSCLMRHLYRRHPEVVGSQKGFLGASLANSPYATLASAESSSSKLTDLPTVVTKNNQVMFPVNSKKTSKLWNHFSICSADSTKVVCLHCGRTISRGKKPTNLGTSCLLRHLQRFHSNVLKTEVSETARPSSPDTRVPRGTELSGASSFDDTNEKFYDSHPVAKKITSLIAEMIALDLQPYSFVDNVGFNRLLEYLKPQYSLPAPSYFSRTAIPGMYDNVKQIIMSHLKEAESGVIHFTSGIWMSNQTREYLTLTAHWVSFESPARPRCDDHHCSALLDVSQVDCDYSGNSIQKQLECWWEAWVTSTGLQVGITVTDNASIGKTLNEGEHSSVQCFSHTVNLIVSEAIKSQRMVQNLLSLARKICERVHRSPKAKEKLAELQREYALPQHHLIQDVPSKWSTSFHMLERLIEQKRAINEMSVECNFRELISCDQWEVMQSVCRALKPFEAASREMSTQMSTLSQVIPMVHILNRKVEMLFEETMGIDTMLRSLKEAMVSRLSATLHDPRYVFATLLDPRYKASLFTEEEAEQYKQDLIRELELMNSTSEDVAASHRCDAGSPSKDSAAEENLWSLVAKVKKKDPREKLPEAMVLAYLEEEVLEHSCDPLTYWNLKKASWPGLSALAVRFLGCPPSIVPSEKLFNTPTENGSLGQSRLMMEHFEKLIFLKVNLPLIYFQY

SEQ ID NO: 15852 - protein, 693 aa, Homo Sapiens
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRKYDESYLSFGFTYFGNRDAPHAQCVLCKKILSNSSLAPSKLRRHLETKHAAYKDKDISFFKQHLDSPENNKPPTPKIVNTDNESATEASYNVSYHIALSGEAHTIGELLIKPCAKDVVMRMFDEQYSKKIDAVQLSNSTVARRIKDLAADIEEELVCRLKICDGFSLQLDESADVSGLAVLLVFVRYRFNKSIEEDLLLCESLQSNATGEEIFNCINSFMQKHEIEWEKCVDVCSDASRAVDGKIAEAVTLIKYVAPESTSSHCLLYRHALAVKIMPTSLKNVLDQAVQIINYIKARPHQSRLLKILCEEMGAQHTALLLNTEVRWLSRGKVLVRLFELRRELLVFMDSAFRLSDCLTNSSWLLRLAYLADIFTKLNEVNLSMQGKNVTVFTVFDKMSSLLRKLEFWASSVEEENFDCFPTLSDFLTEINSTVDKDICSAIVQHLRGLRATLLKYFPVTNDNNAWVRNPFTVTVKPASLVARDYESLIDLTSDSQVKQNFSELSLNDFWSSLIQEYPSIARRAVRVLLPFATMHLCETGFSYYAATKTKYRKRLDAAPHMRIRLSNITPNIKRICDKKTQKHCSH

SEQ ID NO: 15853 - protein, 979 aa, Homo Sapiens
MSVCTLSVPVSSLSPGRRCNTFSDSGILGCVPINSNTDEEDVVEEKMVAEGVNKEAKQPAKKKRKKGLRIKGKRRRKKLILAKKFSKDLGSGRPVADAPALLASNDPEQDEESLFESNIEKQIYLPSTRAKTSIVWHFFHVDPQYTWRAICNLCEKSVSRGKPGSHLGTSTLQRHLQARHSPHWTRANKFGVASGEEDFTLDVSLSPSSGSNGSFEYIPTDPLDDNRMGKKHDKSASDALRAERGRFLIKSNIVKHALIPGTRAKTSAVWNFFYTDPQHISRAVCNICKRSVSRGRPGSHLGTSTLQRHLQATHPIHWAVANKDSGAVANGLDEAETERSDLLSDTLHGEKSTGSQDLTAEDLSDSDSDEPMLEVENRSESPIPVAEQGTLMRAQERETTCCGNPVSSHISQAIIQMIVEDMHPYNYFSTPAFQRFMQIVAPDYRLPSETYFFTKAVPQLYDCVREKIFLTLENVQSQKIHLTVDIWTHDPSTDYFIVTVHWVSLETASFLNNGRIPDFRKWAVLCVTGLAKDCLITNILQELNDQIGLWLSPNFLIPSFIVSDNSSNVVHAIKDGGFTHVPCFLHCLNMVIQDFFCEHKSIENMLVAARKTCHHFSHSVKARQILQEFQNDHQLPWKNLKQDETGHWISTFYMLKWLLEHCYSVHHSLGRASGVVLTSLQWTLMTYVCDILKPFEEATQKVSVKTAGLNQVLPLIHHLLLSLQKLREDFQVRGITQALNLVDSLSLKLETDTLLSAMLKSKPCILATLLDPCFKNSLEDFFPQGADLETYKQFLAEEVCNYMESSPEICQIPTSEASCPSVTVGADSFTSSLKEGTSSSGSVDSSAVDNVALGSKSFMFPSAVAVVDEYFKEKYSEFSGGDDPLIYWQRKISIWPALTQVAIQYLSCPMCSWQSECIFTKNSHFHPKQIMSLDFDNIEQLMFLKMNLKNVNYDYSTLVLSWDPEQNEVVQSSEKEILP

SEQ ID NO: 15854 - protein, 429 aa, Homo Sapiens
MAQAPADPGREGHLEQRILQVLTEAGSPVKLAQLVKECQAPKRELNQVLYRMKKELKVSLTSPATWCLGGTDPEGEGPAELALSSPAERPQQHAATIPETPGPQFSQQREEDIYRFLKDNGPQRALVIAQALGMRTAKDVNRDLYRMKSRHLLDMDEQSKAWTIYRPEDSGRRAKSASIIYQHNPINMICQNGPNSWISIANSEAIQIGHGNIITRQTVSREDGSAGPRHLPSMAPGDSSTWGTLVDPWGPQDIHMEQSILRRVQLGHSNEMRLHGVPSEGPAHIPPGSPPVSATAAGPEASFEARIPSPGTHPEGEAAQRIHMKSCFLEDATIGNSNKMSISPGVAGPGGVAGSGEGEPGEDAGRRPADTQSRSHFPRDIGQPITPSHSKLTPKLETMTLGNRSHKAAEGSHYVDEASHEGSWWGGGI

SEQ ID NO: 15855 - protein, 577 aa, Homo Sapiens
MNKLYIGNLNESVTPADLEKVFAEHKISYSGQFLVKSGYAFVDCPDEHWAMKAIETFSGKVELQGKRLEIEHSVPKKQRSRKIQIRNIPPQLRWEVLDSLLAQYGTVENCEQVNTESETAVVNVTYSNREQTRQAIMKLNGHQLENHALKVSYIPDEQIAQGPENGRRGGFGSRGQPRQGSPVAAGAPAKQQQVDIPLRLLVPTQYVGAIIGKEGATIRNITKQTQSKIDVHRKENAGAAEKAISVHSTPEGCSSACKMILEIMHKEAKDTKTADEVPLKILAHNNFVGRLIGKEGRNLKKVEQDTETKITISSLQDLTLYNPERTITVKGAIENCCRAEQEIMKKVREAYENDVAAMSLQSHLIPGLNLAAVGLFPASSSAVPPPPSSVTGAAPYSSFMQAPEQEMVQVFIPAQAVGAIIGKKGQHIKQLSRFASASIKIAPPETPDSKVRMVIITGPPEAQFKAQGRIYGKLKEENFFGPKEEVKLETHIRVPASAAGRVIGKGGKTVNELQNLTAAEVVVPRDQTPDENDQVIVKIIGHFYASQMAQRKIRDILAQVKQQHQKGQSNQAQARRK

SEQ ID NO: 15856 - protein, 713 aa, Homo Sapiens
MAKPSHSSYVLQQLNNQREWGFLCDCCIAIDDIYFQAHKAVLAACSSYFRMFFMNHQHSTAQLNLSNMKISAECFDLILQFMYLGKIMTAPSSFEQFKVAMNYLQLYNVPDCLEDIQDADCSSSKCSSSASSKQNSKMIFGVRMYEDTVARNGNEANRWCAEPSSTVNTPHNREADEESLQLGNFPEPLFDVCKKSSVSKLSTPKERVSRRFGRSFTCDSCGFGFSCEKLLDEHVLTCTNRHLYQNTRSYHRIVDIRDGKDSNIKAEFGEKDSSKTFSAQTDKYRGDTSQAADDSASTTGSRKSSTVESEIASEEKSRAAERKRIIIKMEPEDIPTDELKDFNIIKVTDKDCNESTDNDELEDEPEEPFYRYYVEEDVSIKKSGRKTLKPRMSVSADERGGLENMRPPNNSSPVQEDAENASCELCGLTITEEDLSSHYLAKHIENICACGKCGQILVKGRQLQEHAQRCGEPQDLTMNGLGNTEEKMDLEENPDEQSEIRDMFVEMLDDFRDNHYQINSIQKKQLFKHSACPFRCPNCGQRFETENLVVEHMSSCLDQDMFKSAIMEENERDHRRKHFCNLCGKGFYQRCHLREHYTVHTKEKQFVCQTCGKQFLRERQLRLHNDMHKGMARYVCSICDQGNFRKHDHVRHMISHLSAGETICQVCFQIFPNNEQLEQHMDVHLYTCGICGAKFNLRKDMRSHYNAKHLKRT

SEQ ID NO: 15857 - protein, 871 aa, Homo Sapiens
MSFSEMNRRTLAFRGGGLVTASGGGSTNNNAGGEASAWPPQPQPRQPPPPAPPALQPPNGRGADEEVELEGLEPQDLEASAGPAAGAAEEAKELLLPQDAGGPTSLGGGAGGPLLAERNRRTLAFRGGGGGGLGNNGSSRGRPETSVWPLRHFNGRGPATVDLELDALEGKELMQDGASLSDSTEDEEEGASLGDGSGAEGGSCSSSRRSGGDGGDEVEGSGVGAGEGETVQHFPLARPKSLMQKLQCSFQTSWLKDFPWLRYSKDTGLMSCGWCQKTPADGGSVDLPPVGHDELSRGTRNYKKTLLLRHHVSTEHKLHEANAQESEIPSEEGYCDFNSRPNENSYCYQLLRQLNEQRKKGILCDVSIVVSGKIFKAHKNILVAGSRFFKTLYCFSNKESPNQNNTTHLDIAAVQGFSVILDFLYSGNLVLTSQNAIEVMTVASYLQMSEVVQTCRNFIKDALNISIKSEAPESVVVDYNNRKPVNRDGLSSSRDQKIASFWATRNLTNLASNVKIENDGCNVDEGQIENYQMNDSSWVQDGSPEMAENESEGQTKVFIWNNMGSQGIQETGKTRRKNQTTKRFIYNIPPNNETNLEDCSVMQPPVAYPEENTLLIKEEPDLDGALLSGPDGDRNVNANLLAEAGTSQDGGDAGTSHDFKYGLMPGPSNDFKYGLIPGTSNDFKYGLIPGASNDFKYGLLPESWPKQETWENGESSLIMNKLKCPHCSYVAKYRRTLKRHLLIHTGVRSFSCDICGKLFTRREHVKRHSLVHKKDKKYKCMVCKKIFMLAASVGIRHGSRRYGVCVDCADKSQPGGQEGVDQGQDTEFPRDEEYEENEVGEADEELVDDGEDQNDPSRWDESGEVCMSLDD

SEQ ID NO: 15858 - protein, 1053 aa, Homo Sapiens
MSSEESYRAILRYLTNEREPYAPGTEGNVKRKIRKAAACYVVRGGTLYYQRRQRHRKTFAELEVVLQPERRRDLIEAAHLGPGGTHHTRHQTWHYLSKTYWWRGILKQVKDYIKQCSKCQEKLDRSRPISDVSEMLEELGLDLESGEESNESEDDLSNFTSSPTTASKPAKKKPVSKHELVFVDTKGVVKRSSPKHCQAVLKQLNEQRLSNQFCDVTLLIEGEEYKAHKSVLSANSEYFRDLFIEKGAVSSHEAVVDLSGFCKASFLPLLEFAYTSVLSFDFCSMADVAILARHLFMSEVLEICESVHKLMEEKQLTVYKKGEVQTVASTQDLRVQNGGTAPPVASSEGTTTSLPTELGDCEIVLLVNGELPEAEQNGEVGRQPEPQVSSEAESALSSVGCIADSHPEMESVDLITKNNQTELETSNNRENNTVSNIHPKLSKENVISSSPEDSGMGNDISAEDICAEDIPKHRQKVDQPLKDQENLVASTAKTDFGPDDDTYRSRLRQRSVNEGAYIRLHKGMEKKLQKRKAVPKSAVQQVAQKLVQRGKKMKQPKRDAKENTEEASHKCGECGMVFQRRYALIMHKLKHERARDYKCPLCKKQFQYSASLRAHLIRHTRKDAPSSSSSNSTSNEASGTSSEKGRTKREFICSICGRTLPKLYSLRIHMLKHTGVKPHACQVCGKTFIYKHGLKLHQSLHQSQKQFQCELCVKSFVTKRSLQEHMSIHTGESKYLCSVCGKSFHRGSGLSKHFKKHQPKPEVRGYHCTQCEKSFFEARDLRQHMNKHLGVKPFQCQFCDKCYSWKKDWYSHVKSHSVTEPYRCNICGKEFYEKALFRRHVKKATHGKKGRAKQNLERVCEKCGRKFTQLREYRRHMNNHEGVKPFECLTCGVAWADARSLKRHVRTHTGERPYVCPVCSEAYIDARTLRKHMTKFHRDYVPCKIMLEKDTLQFHNQGTQVAHAVSILTAGMQEQESSGPQELETVVVTGETMEALEAVAATEEYPSVSTLSDQSIMQVVNYVLAQQQGQKLSEVAEAIQTVKVEVAHISGGE

SEQ ID NO: 15859 - protein, 459 aa, Homo Sapiens
MASGVEVLRFQLPGHEAATLRNMNQLRAEERFCDVTIVADSLKFRGHKVILAACSPFLRDQFLLNPSSELQVSLMHSARIVADLLLSCYTGALEFAVRDIVNYLTAASYLQMEHVVEKCRNALSQFIEPKIGLKEDGVSEASLVSSISATKSLLPPARTPKPAPKPPPPPPLPPPLLRPVKLEFPLDEDLELKAEEEDEDEDEDVSDICIVKVESALEVAHRLKPPGGLGGGLGIGGSVGGHLGELAQSSVPPSTVAPPQGVVKACYSLSEDAEGEGLLLIPGGRASVGATSGLVEAAAVAMAARGAGGSLGAGGSRGPLPGGFSGGNPLKNIKCTKCPEVFQGVEKLVFHMRAQHFIFMCPRCGKQFNHSSNLNRHMNVHRGVKSHSCGICGKCFTQKSTLHDHLNLHSGARPYRCSYCDVRFAHKPAIRRHLKEQHGKTTAENVLEASVAEINVLIR

SEQ ID NO: 15860 - protein, 449 aa, Homo Sapiens
MEFFISMSETIKYNDDDHKTLFLKTLNEQRLEGEFCDIAIVVEDVKFRAHRCVLAACSTYFKKLFKKLEVDSSSVIEIDFLRSDIFEEVLNYMYTAKISVKKEDVNLMMSSGQILGIRFLDKLCSQKRDVSSPDENNGQSKSKYCLKINRPIGDAADTQDDDVEEIGDQDDSPSDDTVEGTPPSQEDGKSPTTTLRVQEAILKELGSEEVRKVNCYGQEVESMETPESKDLGSQTPQALTFNDGMSEVKDEQTPGWTTAASDMKFEYLLYGHHREQIACQACGKTFSDEGRLRKHEKLHTADRPFVCEMCTKGFTTQAHLKEHLKIHTGYKPYSCEVCGKSFIRAPDLKKHERVHSNERPFACHMCDKAFKHKSHLKDHERRHRGEKPFVCGSCTKAFAKASDLKRHENNMHSERKQVTPSAIQSETEQLQAAAMAAEAEQQLETIACS

SEQ ID NO: 15861 - protein, 673 aa, Homo Sapiens; identical to SEQ ID NO: 15499

SEQ ID NO: 15862 - protein, 803 aa, Homo Sapiens
MDFPQHSQHVLEQLNQQRQLGLLCDCTFVVDGVHFKAHKAVLAACSEYFKMLFVDQKDVVHLDISNAAGLGQVLEFMYTAKLSLSPENVDDVLAVATFLQMQDIITACHALKSLAEPATSPGGNAEALATEGGDKRAKEEKVATSTLSRLEQAGRSTPIGPSRDLKEERGGQAQSAASGAEQTEKADAPREPPPVELKPDPTSGMAAAEAEAALSESSEQEMEVEPARKGEEEQKEQEEQEEEGAGPAEVKEEGSQLENGEAPEENENEESAGTDSGQELGSEARGLRSGTYGDRTESKAYGSVIHKCEDCGKEFTHTGNFKRHIRIHTGEKPFSCRECSKAFSDPAACKAHEKTHSPLKPYGCEECGKSYRLISLLNLHKKRHSGEARYRCEDCGKLFTTSGNLKRHQLVHSGEKPYQCDYCGRSFSDPTSKMRHLETHDTDKEHKCPHCDKKFNQVGNLKAHLKIHIADGPLKCRECGKQFTTSGNLKRHLRIHSGEKPYVCIHCQRQFADPGALQRHVRIHTGEKPCQCVMCGKAFTQASSLIAHVRQHTGEKPYVCERCGKRFVQSSQLANHIRHHDNIRPHKCSVCSKAFVNVGDLSKHIIIHTGEKPYLCDKCGRGFNRVDNLRSHVKTVHQGKAGIKILEPEEGSEVSVVTVDDMVTLATEALAATAVTQLTVVPVGAAVTADETEVLKAEISKAVKQVQEEDPNTHILYACDSCGDKFLDANSLAQHVRIHTAQALVMFQTDADFYQQYGPGGTWPAGQVLQAGELVFRPRDGAEGQPALAETSPTAPECPPPAE

SEQ ID NO: 15863 - protein, 522 aa, Homo Sapiens
MEFPDHSRHLLQCLSEQRHQGFLCDCTVLVGDAQFRAHRAVLASCSMYFHLFYKDQLDKRDIVHLNSDIVTAPAFALLLEFMYEGKLQFKDLPIEDVLAAASYLHMYDIVKVCKKKLKEKATTEADSTKKEEDASSCSDKVESLSDGSSHIAGDLPSDEDEGEDEKLNILPSKRDLAAEPGNMWMRLPSDSAGIPQAGGEAEPHATAAGKTVASPCSSTESLSQRSVTSVRDSADVDCVLDLSVKSSLSGVENLNSSYFSSQDVLRSNLVQVKVEKEASCDESDVGTNDYDMEHSTVKESVSTNNRVQYEPAHLAPLREDSVLRELDREDKASDDEMMTPESERVQVEGGMESSLLPYVSNILSPAGQIFMCPLCNKVFPSPHILQIHLSTHFREQDGIRSKPAADVNVPTCSLCGKTFSCMYTLKRHERTHSGEKPYTCTQCGKSFQYSHNLSRHAVVHTREKPHACKWCERRFTQSGDLYRHIRKFHCELVNSLSVKSEALSLPTVRDWTLEDSSQELWK

SEQ ID NO: 15864 - protein, 514 aa, Homo Sapiens
MDLANHGLILLQQLNAQREFGFLCDCTVAIGDVYFKAHKSVLASFSNYFKMLFVHQTSECVRLKPTDIQPDIFSYLLHLMYTGKMAPQLIDPVRLEQGIKFLHAYPLIQEASLASQGAFSHPDQVFPLASSLYGIQIADHQLRQATKIASAPEKLGRDPRPQTSRISQEQVPEASQLSQLTSNLAQVNRTNMTPSDPLQTSLSPELVSTPVPPPPPGEETNLEASSSDEQPASLTIAHVKPSIMKRNGSFPKYYACHLCGRRFTLRSSLREHLQIHTGVPFTSSQQGESRVPLTLCSNAADLGKDAMEVPEAGMISDSELQHISDSPIIDGQQQSETPPPSDIADIDNLEQADQEREVKRRKYECTICGRKFIQKSHWREHMYIHTGKPFKCSTCDKSFCRANQAARHVCLNQSIDTYTMVDKQTLELCTFEEGSQMDNMLVQTNKPYKCNLCDKTFSTPNEVVKHSCQNQNSDVFALDEGRSILLGSGDSEVTEPDHPVLASIKKEQETVLLD

SEQ ID NO: 15865 - protein, 741 aa, Homo Sapiens
MLERKKPKTAENQKASEENEITQPGGSSAKPGLPCLNFEAVLSPDPALIHSTHSLTNSHAHTGSSDCDISCKGMTERIHSINLHNFSNSVLETLNEQRNRGHFCDVTVRIHGSMLRAHRCVLAAGSPFFQDKLLLGYSDIEIPSVVSVQSVQKLIDFMYSGVLRVSQSEALQILTAASILQIKTVIDECTRIVSQNVGDVFPGIQDSGQDTPRGTPESGTSGQSSDTESGYLQSHPQHSVDRIYSALYACSMQNGSGERSFYSGAVVSHHETALGLPRDHHMEDPSWITRIHERSQQMERYLSTTPETTHCRKQPRPVRIQTLVGNIHIKQEMEDDYDYYGQQRVQILERNESEECTEDTDQAEGTESEPKGESFDSGVSSSIGTEPDSVEQQFGPGAARDSQAEPTQPEQAAEAPAEGGPQTNQLETGASSPERSNEVEMDSTVITVSNSSDKSVLQQPSVNTSIGQPLPSTQLYLRQTETLTSNLRMPLTLTSNTQVIGTAGNTYLPALFTTQPAGSGPKPFLFSLPQPLAGQQTQFVTVSQPGLSTFTAQLPAPQPLASSAGHSTASGQGEKKPYECTLCNKTFTAKQNYVKHMFVHTGEKPHQCSICWRSFSLKDYLIKHMVTHTGVRAYQCSICNKRFTQKSSLNVHMRLHRGEKSYECYICKKKFSHKTLLERHVALHSASNGTPPAGTPPGARAGPPGVVACTEGTTYVCSVCPAKFDQIEQFNDHMRMHVSDG

SEQ ID NO: 15866 - protein, 1066 aa, Homo Sapiens
MEGLLHYINPAHAISLLSALNEERLKGQLCDVLLIVGDQKFRAHKNVLAASSEYFQSLFTNKENESQTVFQLDFCEPDAFDNVLNYIYSSSLFVEKSSLAAVQELGYSLGISFLTNIVSKTPQAPFPTCPNRKKVFVEDDENSSQKRSVIVCQSRNEAQGKTVSQNQPDVSHTSRPSPSIAVKANTNKPHVPKPIEPLHNLSLTEKSWPKDSSVVYAKSLEHSGSLDDPNRISLVKRNAVLPSKPLQDREAMDDKPGVSGQLPKGKALELALKRPRPPVLSVCSSSETPYLLKETNKGNGQGEDRNLLYYSKLGLVIPSSGSGSGNQSIDRSGPLVKSLLRRSLSMDSQVPVYSPSIDLKSSQGSSSVSSDAPGNVLCALSQKSSLKDCSEKTALDDRPQVLQPHRLRSFSASQSTDREGASPVTEVRIKTEPSSPLSDPSDIIRVTVGDAATTAAASSSSVTRDLSLKTEDDQKDMSRLPAKRRFQADRRLPFKKLKVNEHGSPVSEDNFEEGSSPTLLDADFPDSDLNKDEFGELEGTRPNKKFKCKHCLKIFRSTAGLHRHVNMYHNPEKPYACDICHKRFHTNFKVWTHCQTQHGIVKNPSPASSSHAVLDEKFQRKLIDIVREREIKKALIIKLRRGKPGFQGQSSSQAQQVIKRNLRSRAKGAYICTYCGKAYRFLSQFKQHIKMHPGEKPLGVNKVAKPKEHAPLASPVENKEVYQCRLCNAKLSSLLEQGSHERLCRNAAVCPYCSLRFFSPELKQEHESKCEYKKLTCLECMRTFKSSFSIWRHQVEVHNQNNMAPTENFSLPVLDHNGDVTGSSRPQSQPEPNKVNHIVTTKDDNVFSDSSEQVNFDSEDSSCLPEDLSLSKQLKIQVKEEPVEEAEEEAPEASTAPKEAGPSKEASLWPCEKCGKMFTVHKQLERHQELLCSVKPFICHVCNKAFRTNFRLWSHFQSHMSQASEESAHKESEVCPVPTNSPSPPPLPPPPPLPKIQPLEPDSPTGLSENPTPATEKLFVPQESDTLFYHAPPLSAITFKRQFMCKLCHRTFKTAFSLWSHEQTHN

SEQ ID NO: 15867 - protein, 634 aa, Homo Sapiens
MEPSPLSPSGAALPLPLSLAPPPLPLPAAAVVHVSFPEVTSALLESLNQQRLQGQLCDVSIRVQGREFRAHRAVLAASSPYFHDQVLLKGMTSISLPSVMDPGAFETVLASAYTGRLSMAAADIVNFLTVGSVLQMWHIVDKCTELLREGRASATTTITTAAATSVTVPGAGVPSGSGGTVAPATMGSARSHASSRASENQSPSSSNYFSPRESTDFSSSSQEAFAASAVGSGERRGGGPVFPAPVVGSGGATSGKLLLEADELCDDGGDGRGAVVPGAGLRRPTYTPPSIMPQKHWVYVKRGGNCPAPTPLVPQDPDLEEEEEEEDLVLTCEDDEDEELGGSSRVPVGGGPEATLSISDVRTLSEPPDKGEEQVNFCESSNDFGPYEGGGPVAGLDDSGGPTPSSYAPSHPPRPLLPLDMQGNQILVFPSSSSSSSSQAPGQPPGNQAEHGAVTVGGTSVGSLGVPGSVGGVPGGTGSGDGNKIFLCHCGKAFSHKSMRDRHVNMHLNLRPFDCPVCNKKFKMKHHLTEHMKTHTGLKPYECGVCAKKFMWRDSFMRHRGHCERRHRLGGVGAVPGPGTPTGPSLPSKRESPGVGGGSGDEASAATPPSSRRVWSPPRVHKVEMGFGGGGGAN

SEQ ID NO: 15868 - protein, 697 aa, Homo Sapiens
MAETSPEPSGQLVVHSDAHSDTVLASFEDQRKKGFLCDITLIVENVHFRAHKALLAASSEYFSMMFAEEGEIGQSIYMLEGMVADTFGILLEFIYTGYLHASEKSTEQILATAQFLKVYDLVKAYTDFQNNHSSPKPTTLNTAGAPVVVISNKKNDPPKRKRGRPKKVNTLQEEKSELAAEEEIQLRVNNSVQNRQNFVVKGDSGVLNEQIAAKEKEESEPTCEPSREEEMPVEKDENYDPKTEDGQASQSRYSKRRIWRSVKLKDYKLVGDQEDHGSAKRICGRRKRPGGPEARCKDCGKVFKYNHFLAIHQRSHTGERPFKCNECGKGFAQKHSLQVHTRMHTGERPYTCTVCSKALTTKHSLLEHMSLHSGQKSFTCDQCGKYFSQNRQLKSHYRVHTGHSLPECKDCHRKFMDVSQLKKHLRTHTGEKPFTCEICGKSFTAKSSLQTHIRIHRGEKPYSCGICGKSFSDSSAKRRHCILHTGKKPFSCPECNLQFARLDNLKAHLKIHSKEKHASDASSISGSSNTEEVRNILQLQPYQLSTSGEQEIQLLVTDSVHNINFMPGPSQGISIVTAESSQNMTADQAANLTLLTQQPEQLQNLILSAQQEQTEHIQSLNMIESQMGPSQTEPVHVITLSKETLEHLHAHQEQTEELHLATSTSDPAQHLQLTQEPGPPPPTHHVPQPTPLGQEQS

SEQ ID NO: 15869 - protein, 435 aa, Homo Sapiens
MDTASHSLVLLQQLNMQREFGFLCDCTVAIGDVYFKAHRAVLAAFSNYFKMIFIHQTSECIKIQPTDIQPDIFSYLLHIMYTGKGPKQIVDHSRLEEGIRFLHADYLSHIATEMNQVFSPETVQSSNLYGIQISTTQKTVVKQGLEVKEAPSSNSGNRAAVQGDHPQLQLSLAIGLDDGTADQQRACPATQALEEHQKPPVSIKQERCDPESVISQSHPSPSSEVTGPTFTENSVKIHLCHYCGERFDSRSNLRQHLHTHVSGSLPFGVPASILESNDLGEVHPLNENSEALECRRLSSFIVKENEQQPDHTNRGTTEPLQISQVSLISKDTEPVELNCNFSFSRKRKMSCTICGHKFPRKSQLLEHMYTHKGKSYRYNRCQRFGNALAQRFQPYCDSWSDVSLKSSRLSQEHLDLPCALESELTQENVDTILVE

SEQ ID NO: 15870 - protein, 441 aa, Homo Sapiens
MSERSDLLHFKFENYGDSMLQKMNKLREENKFCDVTVLIDDIEVQGHKIVFAAGSPFLRDQFLLNDSREVKISILQSSEVGRQLLLSCYSGVLEFPEMELVNYLTAASFLQMSHIVERCTQALWKFIKPKQPMDSKEGCEPQSASPQSKEQQGDARGSPKQDSPCIHPSEDSMDMEDSDIQIVKVESIGDVSEVRSKKDQNQFISSEPTALHSSEPQHSLINSTVENRVSEIEQNHLHNYALSYTGSDNIIMASKDVFGPNIRGVDKGLQWHHQCPKCTRVFRHLENYANHLKMHKLFMCLLCGKTFTQKGNLHRHMRVHAGIKPFQCKICGKTFSQKCSLQDHLNLHSGDKPHKCNYCDMVFAHKPVLRKHLKQLHGKNSFDNANERNVQDLTVDFDSFACTTVTDSKGCQPQPDATQVLDAGKLAQAVLNLRNDSTCVN

SEQ ID NO: 15871 - protein, 574 aa, Homo Sapiens
MLREFSKWGVEASPGKAWERKRSLLRGAVGRYRGATGGDLFWAPFPSWGTMEFPEHSQQLLQSLREQRSQGFLCDCTVMVGSTQFLAHRAVLASCSPFFQLFYKERELDKRDLVCIHNEIVTAPAFGLLLDFMYAGQLTLRGDTPVEDVLAAASYLHMNDIVKVCKRRLQARALAEADSTKKEEETNSQLPSLEFLSSTSRGTQPSLASAETSGHWGKGEWKGSAAPSPTVRPPDEPPMSSGADTTQPGMEVDAPHLRAPHPPVADVSLASPSSSTETIPTNYFSSGISAVSLEPLPSLDVGPESLRVVEPKDPGGPLQGFYPPASAPTSAPAPVSAPVPSQAPAPAEAELVQVKVEAIVISDEETDVSDEQPQGPERAFPSGGAVYGAQPSQPEAFEDPGAAGLEEVGPSDHFLPTDPHLPYHLLPGAGQYHRGLVTSPLPAPASLHEPLYLSSEYEAAPGSFGVFTEDVPTCKTCGKTFSCSYTLRRHATVHTRERPYECRYCLRSYTQSGDLYRHIRKAHNEDLAKRSKPDPEVGPLLGVQPLPGSPTADRQSSSGGGPPKDFVLAPKTNI

SEQ ID NO: 15872 - protein, 487 aa, Homo Sapiens
MSLPPIRLPSPYGSDRLVQLAARLRPALCDTLITVGSQEFPAHSLVLAGVSQQLGRRGQWALGEGISPSTFAQLLNFVYGESVELQPGELRPLQEAARALGVQSLEEACWRARGDRAKKPDPGLKKHQEEPEKPSRNPERELGDPGEKQKPEQVSRTGGREQEMLHKHSPPRGRPEMAGATQEAQQEQTRSKEKRLQAPVGQRGADGKHGVLTWLRENPGGSEESLRKLPGPLPPAGSLQTSVTPRPSWAEAPWLVGGQPALWSILLMPPRYGIPFYHSTPTTGAWQEVWREQRIPLSLNAPKGLWSQNQLASSSPTPGSLPQGPAQLSPGEMEESDQGHTGALATCAGHEDKAGCPPRPHPPPAPPARSRPYACSVCGKRFSLKHQMETHYRVHTGEKPFSCSLCPQRSRDFSAMTKHLRTHGAAPYRCSLCGAGCPSLASMQAHMRGHSPSQLPPGWTIRSTFLYSSSRPSRPSTSPCCPSSSTT

SEQ ID NO: 15873 - protein, 672 aa, Homo Sapiens
MESRKLISATDIQYSGSLLNSLNEQRGHGLFCDVTVIVEDRKFRAHKNILSASSTYFHQLFSVAGQVVELSFIRAEIFAEILNYIYSSKIVRVRSDLLDELIKSGQLLGVKFIAELGVPLSQVKSISGTAQDGNTEPLPPDSGDKNLVIQKSKDEAQDNGATIMPIITESFSLSAEDYEMKKIIVTDSDDDDDDVIFCSEILPTKETLPSNNTVAQVQSNPGPVAISDVAPSASNNSPPLTNITPTQKLPTPVNQATLSQTQGSEKLLVSSAPTHLTPNIILLNQTPLSTPPNVSSSLPNHMPSSINLLVQNQQTPNSAILTGNKANEEEEEEIIDDDDDTISSSPDSAVSNTSLVPQADTSQNTSFDGSLIQKMQIPTLLQEPLSNSLKISDIITRNTNDPGVGSKHLMEGQKIITLDTATEIEGLSTGCKVYANIGEDTYDIVIPVKDDPDEGEARLENEIPKTSGSEMANKRMKVKHDDHYELIVDGRVYYICIVCKRSYVCLTSLRRHFNIHSWEKKYPCRYCEKVFPLAEYRTKHEIHHTGERRYQCLACGKSFINYQFMSSHIKSVHSQDPSGDSKLYRLHPCRSLQIRQYAYLSDRSSTIPAMKDDGIGYKVDTGKEPPVGTTTSTQNKPMTWEDIFIQQENDSIFKQNVTDGSTEFEFIIPESY

SEQ ID NO: 15874 - protein, 500 aa, Homo Sapiens
MDSSSFIQFDVPEYSSTVLSQLNELRLQGKLCDIIVHIQGQPFRAHKAVLAASSPYFRDHSALSTMSGLSISVIKNPNVFEQLLSFCYTGRMSLQLKDVVSFLTAASFLQMQCVIDKCTQILESIHSKISVGDVDSVTVGAEENPESRNGVKDSSFFANPVEISPPYCSQGRQPTASSDLRMETTPSKALRSRLQEEGHSDRGSSGSVSEYEIQIEGDHEQGDLLVRESQITEVKVKMEKSDRPSCSDSSSLGDDGYHTEMVDGEQVVAVNVGSYGSVLQHAYSYSQAASQPTNVSEAFGSLSNSSPSRSMLSCFRGGRARQKRALSVHLHSDLQGLVQGSDSEAMMNNPGYESSPRERSARGHWYPYNERLICIYCGKSFNQKGSLDRHMRLHMGITPFVCKFCGKKYTRKDQLEYHIRGHTDDKPFRCEICGKCFPFQGTLNQHLRKNHPGVAEVRSRIESPERTDVYVEQKLENDASASEMGLDSRMEIHTVSDAPD

SEQ ID NO: 15875 - protein, 503 aa, Homo Sapiens
MEKGGNIQLEIPDFSNSVLSHLNQLRMQGRLCDIVVNVQGQAFRAHKVVLAASSPYFRDHMSLNEMSTVSISVIKNPTVFEQLLSFCYTGRICLQLADIISYLTAASFLQMQHIIDKCTQILEGIHFKINVAEVEAELSQTRTKHQERPPESHRVTPNLNRSLSPRHNTPKGNRRGQVSAVLDIRELSPPEESTSPQIIEPSSDVESREPILRINRAGQWYVETGVADRGGRSDDEVRVLGAVHIKTENLEEWLGPENQPSGEDGSSAEEVTAMVIDTTGHGSVGQENYTLGSSGAKVARPTSSEVDRFSPSGSVVPLTERHRARSESPGRMDEPKQPSSQVEESAMMGVSGYVEYLREQEVSERWFRYNPRLTCIYCAKSFNQKGSLDRHMRLHMGITPFVCRMCGKKYTRKDQLEYHIRKHTGNKPFHCHVCGKSFPFQAILNQHFRKNHPGCIPLEGPHSISPETTVTSRGQAEEESPSQEETVAPGEAVQGSVSTTGPD

SEQ ID NO: 15876 - protein, 1195 aa, Homo Sapiens
MTVMSLSRDLKDDFHSDTVLSILNEQRIRGILCDVTIIVEDTKFKAHSNVLAASSLYFKNIFWSHTICISSHVLELDDLKAEVFTEILNYIYSSTVVVKRQETVTDLAAAGKKLGISFLEDLTDRNFSNSPGPYVFCITEKGVVKEEKNEKRHEEPAITNGPRITNAFSIIETENSNNMFSPLDLRASFKKVSDSMRTASLCLERTDVCHEAEPVRTLAEHSYAVSSVAEAYRSQPVREHDGSSPGNTGKENCEALAAKPKTCRKPKTFSIPQDSDSATENIPPPPVSNLEVNQERSPQPAAVLTRSKSPNNEGDVHFSREDENQSSDVPGPPAAEVPPLVYNCSCCSKAFDSSTLLSAHMQLHKPTQEPLVCKYCNKQFTTLNRLDRHEQICMRSSHMPIPGGNQRFLENYPTIGQNGGSFTGPEPLLSENRIGEFSSTGSTLPDTDHMVKFVNGQMLYSCVVCKRSYVTLSSLRRHANVHSWRRTYPCHYCNKVFALAEYRTRHEIWHTGERRYQCIFCLETFMTYYILKNHQKSFHAIDHRLSISKKTANGGLKPSVYPYKLYRLLPMKCKRAPYKSYRNSSYENARENSQMNESAPGTYVVQNPHSSELPTLNFQDTVNTLTNSPAIPLETSACQDIPTSANVQNAEGTKWGEEALKMDLDNNFYSTEVSVSSTENAVSSDLRAGDVPVLSLSNSSENAASVISYSGSAPSVIVHSSQFSSVIMHSNAIAAMTSSNHRAFSDPAVSQSLKDDSKPEPDKVGRFASRPKSIKEKKKTTSHTRGEIPEESNYVADPGGSLSKTTNIAEETSKIETYIAKPALPGTSTNSNVAPLCQITVKIGNEAIVKRHILGSKLFYKRGRRPKYQMQEEPLPQGNDPEPSGDSPLGLCQSECMEMSEVFDDASDQDSTDKPWRPYYNYKPKKKSRQLKKMRKVNWRKEHGNRSPSHKCKYPAELDCAVGKAPQDKPFEEEETKEMPKLQCELCDGDKAVGAGNQGRPHRHLTSRPYACELCAKQFQSPSTLKMHMRCHTGEKPYQCKTCGRCFSVQGNLQKHERIHLGLKEFVCQYCNKAFTLNETLKIHERIHTGEKRYHCQFCFQRFLYLSTKRNHEQRHIREHNGKGYACFQCPKICKTAAALGMHQKKHLFKSPSQQEKIGDVCHENSNPLENQHFIGSEDNDQKDNIQTGVENVVL

SEQ ID NO: 15877 - protein, 712 aa, Homo Sapiens
MGMRIKLQSTNHPNNLLKELNKCRLSETMCDVTIVVGSRSFPAHKAVLACAAGYFQNLFLNTGLDAARTYVVDFITPANFEKVLSFVYTSELFTDLINVGVIYEVAERLGMEDLLQACHSTFPDLESTARAKPLTSTSESHSGTLSCPSAEPAHPLGELRGGGDYLGADRNYVLPSDAGGSYKEEEKNVASDANHSLHLPQPPPPPPKTEDHDTPAPFTSIPSMMTQPLLGTVSTGIQTSTSSCQPYKVQSNGDFSKNSFLTPDNAVDITTGTNSCLSNSEHSKDPGFGQMDELQLEDLGDDDLQFEDPAEDIGTTEEVIELSDDSEDELAFGENDNRENKAMPCQVCKKVLEPNIQLIRQHARDHVDLLTGNCKVCETHFQDRNSRVTHVLSHIGIFLFSCDMCETKFFTQWQLTLHRRDGIFENNIIVHPNDPLPGKLGLFSGAASPELKCAACGKVLAKDFHVVRGHILDHLNLKGQACSVCDQRHLNLCSLMWHTLSHLGISVFSCSVCANSFVDWHLLEKHMAVHQSLEDALFHCRLCSQSFKSEAAYRYHVSQHKCNSGLDARPGFGLQHPALQKRKLPAEEFLGEELALQGQPGNSKYSCKVCGKRFAHTSEFNYHRRIHTGEKPYQCKVCHKFFRGRSTIKCHLKTHSGALMYRCTVCGHYSSTLNLMSKHVGVHKGSLPPDFTIEQTFMYIIHSKEADKNPDS

SEQ ID NO: 15878 - protein, 1013 aa, Homo Sapiens
MPPPAEVTDPSHAPAVLRQLNEQRLRGLFCDVTLIAGDTKFPAHRSVLAASSPFFREALLTSAPLPLPPATGGAAPNPATTTAASSSSSSSSSSSSSSSSASSSSSSSSSSPPPASPPASSPPRVLELPGVPAAAFSDVLNFIYSARLALPGGGGDGAAVAEIGALGRRLGISRLQGLGEGGDAWVPPTPAPMATSQPEEDSFGPGPRPAGEWEGDRAEAQAPDLQCSLPRRPLPCPQCGKSFIHPKRLQTHEAQCRRGASTRGSTGLGAGGAGPGGPAGVDASALPPPVGFRGGPEHVVKVVGGHVLYVCAACERSYVTLSSLKRHSNVHSWRRKYPCRYCEKVFALAEYRTKHEVWHTGERRYQCIFCWETFVTYYNLKTHQRAFHGISPGLLASEKTPNGGYKPKLNTLKLYRLLPMRAAKRPYKTYSQGAPEAPLSPTLNTPAPVAMPASPPPGPPPAPEPGPPPSVITFAHPAPSVIVHGGSSSGGGGSGTASTGGSQAASVITYTAPPRPPKKREYPPPPPEPAATPTSPATAVSPATAAGPAMATTTEEAKGRNPRAGRTLTYTAKPVGGIGGGGGPPTGAGRGPSQLQAPPPLCQITVRIGEEAIVKRRISETDLRPGELSGEEMEESEEDEEEEDEEEEEEDEEESKAGGEDQLWRPYYSYKPKRKAGAAGGASVGGSGLPRGRRPPRWRQKLERRSWEETPAAESPAGRARTERRHRCGDCAQTFTTLRKLRKHQEAHGGGSHSSRAGRRPSTRFTCPHCAKVCKTAAALSRHGQRHAAERPGGTPTPVIAYSKGSAGTRPGDVKEEAPQEMQVSSSSGEAGGGSTAAEEASETASLQDPIISGGEEPPVVASGGSYVYPPVQEFPLALIGGGREPGGGRGKSGSEGPVGAGEGDRMEGIGAAKVTFYPEPYPLVYGPQLLAAYPYNFSNLAALPVALNMVLPDEKGAGALPFLPGVFGYAVNPQAAPPAPPTPPPPTLPPPIPPKGEGERAGVERTQKGDVG

SEQ ID NO: 15879 - protein, 1239 aa, Homo Sapiens
MELPNYSRQLLQQLYTLCKEQQFCDCTISIGTIYFRAHKLVLAAASLLFKTLLDNTDTISIDASVVSPEEFALLLEMMYTGKLPVGKHNFSKIISLADSLQMFDVAVSCKNLLTSLVNCSVQGQVVRDVSAPSSETFRKEPEKPQVEILSSEGAGEPHSSPELAATPGGPVKAETEEAAHSVSQEMSVNSPTAQESQRNAETPAETPTTAEACSPSPAVQTFSEAKKTSTEPGCERKHYQLNFLLENEGVFSDALMVTQDVLKKLEMCSEIKGPQKEMIVKCFEGEGGHSAFQRILGKVREESLDVQTVVSLLRLYQYSNPAVKTALLDRKPEDVDTVQPKGSTEEGKTLSVLLLEHKEDLIQCVTQLRPIMESLETAKEEFLTGTEKRVILNCCEGRTPKETIENLLHRMTEEKTLTAEGLVKLLQAVKTTFPNLGLLLEKLQKSATLPSTTVQPSPDDYGTELLRRYHENLSEIFTDNQILLKMISHMTSLAPGEREVMEKLVKRDSGSGGFNSLISAVLEKQTLSATAIWQLLLVVQETKTCPLDLLMEEIRREPGADAFFRAVTTPEHATLETILRHNQLILEAIQQKIEYKLFTSEEEHLAETVKEILSIPSETASPEASLRAVLSRAMEKSVPAIEICHLLCSVHKSFPGLQPVMQELAYIGVLTKEDGEKETWKVSNKFHLEANNKEDEKAAKEDSQPGEQNDQGETGSLPGQQEKEASASPDPAKKSFICKACDKSFHFYCRLKVHMKRCRVAKSKQVQCKECSETKDSKKELDKHQLEAHGAGGEPDAPKKKKKRLPVTCDLCGREFAHASGMQYHKLTEHFDEKPFSCEECGAKFAANSTLKNHLRLHTGDRPFMCKHCLMTFTQASALAYHTKKKHSEGKMYACQYCDAVFAQSIELSRHVRTHTGDKPYVCRDCGKGFRQANGLSIHLHTFHNIEDPYDCKKCRMSFPTLQDHRKHIHEVHSKEYHPCPTCGKIFSAPSMLERHVVTHVGGKPFSCGICNKAYQQLSGLWYHNRTHHPDVFAAQNHRSSKFSSLQCSSCDKTFPNTIEHKKHIKAEHADMKFHECDQCKELFPTPALLQVHVKCQHSGSQPFRCLYCAATFRFPGALQHHVTTEHFKQSETTFPCELCGELFTSQAQLDSHLESEHPKVMSTETQAAASQMAQVIQTPEPVAPTEQVITLEETQLAGSQVFVTLPDSQASQASSELVAVTVEDLLDGTVTLICGEAK

SEQ ID NO: 15880 - protein, 909 aa, Homo Sapiens
MKKRRKVTSNLEKIHLGYHKDSSEGNVAVECDQVTYTHSAGRPTPEALHCYQELPPSPDQRKLLSSLQYNKNLLKYLNDDRQKQPSFCDLLIIVEGKEFSAHKVVVAVGSSYFHACLSKNPSTDVVTLDHVTHSVFQHLLEFLYTSEFFVYKYEIPLVLEAAKFLDIIDAVKLLNNENVAPFHSELTEKSSPEETLNELTGRLSNNHQCKFCSRHFCYKKSLENHLAKTHRSLLLGKKHGLKMLERSFSARRSKRNRKCPVKFDDTSDDEQESGDGSDNLNQENFDKEKSDRNDSEDPGSEYNAEEDELEEEMSDEYSDIEEQSEKDHNDAEEEPEAGDSVGNVHEGLTPVVIQNSNKKILQCPKCDKTFDRIGKYESHTRVHTGEKPFECDICHQRYSTKSNLTVHRKKHSNETEFHKKEHKCPYCNKLHASKKTLAKHVKRFHPENAQEFISIKKTKSESWKCDICKKSFTRRPHLEEHMILHSQDKPFKCTYCEEHFKSRFARLKHQEKFHLGPFPCDICGRQFNDTGNLKRHIECTHGGKRKWTCFICGKSVRERTTLKEHLRIHSGEKPHLCSICGQSFRHGSSYRLHLRVHHDDKRYECDECGKTFIRHDHLTKHKKIHSGEKAHQCEECGKCFGRRDHLTVHYKSVHLGEKVWQKYKATFHQCDVCKKIFKGKSSLEMHFRTHSGEKPYKCQICNQSFRIKKTLTKHLVIHSDARPFNCQHCNATFKRKDKLKYHIDHVHEIKSPDDPLSTSEEKLVSLPVEYSSDDKIFQTETKQYMDQPKVYQSEAKTMLQNVSAEVCVPVTLVPVQMPDTPSDLVRHTTTLPPSSHEILSPQPQSTDYPRAADLAFLEKYTLTPQPANIVHPVRPEQMLDPREQSYLGTLLGLDSTTGVQNISTNEHHS

SEQ ID NO: 15881 - protein, 422 aa, Homo Sapiens
MEFPEHGGRLLGRLRQQRELGFLCDCTVLVGDARFPAHRAVLAACSVYFHLFYRDRPAGSRDTVRLNGDIVTAPAFGRLLDFMYEGRLDLRSLPVEDVLAAASYLHMYDIVKVCKGRLQEKDRSLDPGNPAPGAEPAQPPCPWPVWTADLCPAARKAKLPPFGVKAALPPRASGPPPCQVPEESDQALDLSLKSGPRQERVHPPCVLQTPLCSQRQPGAQPLVKDERDSLSEQEESSSSRSPHSPPKPPPVPAAKGLVVGLQPLPLSGEGSRELELGAGRLASEDELGPGGPLCICPLCSKLFPSSHVLQLHLSAHFRERDSTRARLSPDGVAPTCPLCGKTFSCTYTLKRHERTHSGEKPYTCVQCGKSFQYSHNLSRHTVVHTREKPHACRWCERRFTQSGDLYRHVRKFHCGLVKSLLV

SEQ ID NO: 15882 - protein, 467 aa, Homo Sapiens
MEPGTNSFRVEFPDFSSTILQKLNQQRQQGQLCDVSIVVQGHIFRAHKAVLAASSPYFCDQVLLKNSRRIVLPDVMNPRVFENILLSSYTGRLVMPAPEIVSYLTAASFLQMWHVVDKCTEVLEGNPTVLCQKLNHGSDHQSPSSSSYNGLVESFELGSGGHTDFPKAQELRDGENEEESTKDELSSQLTEHEYLPSNSSTEHDRLSTEMASQDGEEGASDSAEFHYTRPMYSKPSIMAHKRWIHVKPERLEQACEGMDVHATYDEHQVTESINTVQTEHTVQPSGVEEDFHIGEKKVEAEFDEQADESNYDEQVDFYGSSMEEFSGERSDGNLIGHRQEAALAAGYSENIEMVTGIKEEASHLGFSATDKLYPCQCGKSFTHKSQRDRHMSMHLGLRPYGCGVCGKKFKMKHHLVGHMKIHTGIKPYECNICAKRFMWRDSFHRHVTSCTKSYEAAKAEQNTTEAN

SEQ ID NO: 15883 - protein, 570 aa, Homo Sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLELPGPSETGRRMADYVTCESTKTTLPLGTEEDVRVKVERLSDEEVHEEVSQPVSASQSSLSDQQTVPGSEQVQEDLLISPQSSSIGSVDEGVSEGLPTLQSTSSTNAPPDDDDRLENVQYPYQLYIAPSTSSTERPSPNGPDRPFQCPTCGVRFTRIQNLKQHMLIHSGIKPFQCDRCGKKFTRAYSLKMHRLKHEGKRCFRCQICSATFTSFGEYKHHMRVSRHIIRKPRIYECKTCGAMLTNSGNLIVHLRSLNHEASELANYFQSSDFLVPDYLNQEQEETLVQYDLGEHGFESNSSVQMPVISQYHSKGKEP

SEQ ID NO: 15884 - protein, 511 aa, Homo Sapiens
MAAAEAVHHIHLQNFSRSLLETLNGQRLGGHFCDVTVRIREASLRAHRCVLAAGSPFFQDKLLLGHSEIRVPPVVPAQTVRQLVEFLYSGSLVVAQGEALQVLTAASVLRIQTVIDECTQIIARARAPGTSAPTPLPTPVPPPLAPAQLRHRLRHLLAARPPGHPGAAHSRKQRQPARLQLPAPPTPAKAEGPDADPSLSAAPDDRGDEDDEESDDETDGEDGEGGGPGEGQAPPSFPDCAAGFLTAAADSACEEPPAPTGLADYSGAGRDFLRGAGSAEDVFPDSYVSTWHDEDGAVPEGCPTETPVQPDCILSGSRPPGVKTPGPPVALFPFHLGAPGPPAPPPSAPSGPAPAPPPAFYPTLQPEAAPSTQLGEVPAPSAAPTTAPSGTPARTPGAEPPTYECSHCRKTFSSRKNYTKHMFIHSGEKPHQCAVCWRSFSLRDYLLKHMVTHTGVRAFQCAVCAKRFTQKSSLNVHMRTHRPERAPCPACGKVFSHRALLERHLAAHPAP

SEQ ID NO: 15885 - protein, 589 aa, Homo Sapiens
MNNRKEDMEITSHYRHLLRELNEQRQHGVLCDVCVVVEGKVFKAHKNVLLGSSRYFKTLYCQVQKTSEQATVTHLDIVTAQGFKAIIDFMYSAHLALTSRNVIEVMSAASFLQMTDIVQACHDFIKAALDISIKSDASDELAEFEIGASSSSSTEALISAVMAGRSISPWLARRTSPANSSGDSAIASCHDGGSSYGKEDQEPKADGPDDVSSQPLWPGDVGYGPLRIKEEQVSPSQYGGSELPSAKDGAVQNSFSEQSAGDAWQPTGRRKNRKNKETVRHITQQVEDDSRASSPVPSFLPTSGWPFSSRDSNADLSVTEASSSDSRGERAELYAQVEEGLLGGEASYLGPPLTPEKDDALHQATAVANLRAALMSKNSLLSLKADVLGDDGSLLFEYLPRGAHSLSLNEFTVIRKKFKCPYCSFSAMHQCILKRHMRSHTGERPYPCEICGKKFTRREHMKRHTLVHSKDKKYVCKVCSRVFMSAASVGIRHGSRRHGVCTDCAGRGMAGPLDHGGGGGEGSPEALFPGDGPYLEDPEDPRGEAEELGEDDEGLAPEDALLADDKDEEDSPRPRSPPGGPDKDFAWLS

SEQ ID NO: 15886 - protein, 747 aa, Homo Sapiens
MGRLNEQRLFQPDLCDVDLVLVPQRSVFPAHKGVLAAYSQFFHSLFTQNKQLQRVELSLEALAPGGLQQILNFIYTSKLLVNAANVHEVLSAASLLQMADIAASCQELLDARSLGPPGPGTVALAQPAASCTPAAPPYYCDIKQEADTPGLPKIYAREGPDPYSVRVEDGAGTAGGTVPATIGPAQPFFKEEKEGGVEEAGGPPASLCKLEGGEELEEELGGSGTYSRREQSQIIVEVNLNNQTLHVSTGPEGKPGAGPSPATVVLGREDGLQRHSDEEEEDDEEEEEEEEEEEGGGSGREEEEEEEGGSQGEEEEEEEDGHSEQEEEEEEEEEEGPSEQDQESSEEEEGEEGEAGGKQGPRGSRSSRADPPPHSHMATRSRENARRRGTPEPEEAGRRGGKRPKPPPGVASASARGPPATDGLGAKVKLEEKQHHPCQKCPRVFNNRWYLEKHMNVTHSRMQICDQCGKRFLLESELLLHRQTDCERNIQCVTCGKAFKKLWSLHEHNKIVHGYAEKKFSCEICEKKFYTMAHVRKHMVAHTKDMPFTCETCGKSFKRSMSLKVHSLQHSGEKPFRCENCNERFQYKYQLRSHMSIHIGHKQFMCQWCGKDFNMKQYFDEHMKTHTGEKPYICEICGKSFTSRPNMKRHRRTHTGEKPYPCDVCGQRFRFSNMLKAHKEKCFRVSHTLAGDGVPAAPGLPPTQPQAHALPLLPGLPQTLPPPPHLPPPPPLFPTTASPGGRMNANN

SEQ ID NO: 15887 - protein, 688 aa, Homo Sapiens
MDGSFVQHSVRVLQELNKQREKGQYCDATLDVGGLVFKAHWSVLACCSHFFQSLYGDGSGGSVVLPAGFAEIFGLLLDFFYTGHLALTSGNRDQVLLAARELRVPEAVELCQSFKPKTSVGQAAGGQSGLGPPASQNVNSHVKEPAGLEEEEVSRTLGLVPRDQEPRGSHSPQRPQLHSPAQSEGPSSLCGKLKQALKPCPLEDKKPEDCKVPPRPLEAEGAQLQGGSNEWEVVVQVEDDGDGDYMSEPEAVLTRRKSNVIRKPCAAEPALSAGSLAAEPAENRKGTAVPVECPTCHKKFLSKYYLKVHNRKHTGEKPFECPKCGKCYFRKENLLEHEARNCMNRSEQVFTCSVCQETFRRRMELRVHMVSHTGEMPYKCSSCSQQFMQKKDLQSHMIKLHGAPKPHACPTCAKCFLSRTELQLHEAFKHRGEKLFVCEECGHRASSRNGLQMHIKAKHRNERPHVCEFCSHAFTQKANLNMHLRTHTGEKPFQCHLCGKTFRTQASLDKHNRTHTGERPFSCEFCEQRFTEKGPLLRHVASRHQEGRPHFCQICGKTFKAVEQLRVHVRRHKGVRKFECTECGYKFTRQAHLRRHMEIHDRVENYNPRQRKLRNLIIEDEKMVVVALQPPAELEVGSAEVIVESLAQGGLASQLPGQRLCAEESFTGPGVLEPSLIITAAVPEDCDT

SEQ ID NO: 15888 - protein, 765 aa, Homo Sapiens
MDPVATHSCHLLQQLHEQRIQGLLCDCMLVVKGVCFKAHKNVLAAFSQYFRSLFQNSSSQKNDVFHLDVKNVSGIGQILDFMYTSHLDLNQDNIQVMLDTAQCLQVQNVLSLCHTFLKSATVVQPPGMPCNSTLSLQSTLTPDATCVISENYPPHLLQECSADAQQNKTLDESHPHASPSVNRHHSAGEISKQAPDTSDGSCTELPFKQPNYYYKLRNFYSKQYHKHAAGPSQERVVEQPFAFSTSTDLTTVESQPCAVSHSECILESPEHLPSNFLAQPVNDSAPHPESDATCQQPVKQMRLKKAIHLKKLNFLKSQKYAEQVSEPKSDDGLTKRLESASKNTLEKASSQSAEEKESEEVVSCENFNCISETERPEDPAALEDQSQTLQSQRQYACELCGKPFKHPSNLELHKRSHTGEKPFECNICGKHFSQAGNLQTHLRRHSGEKPYICEICGKRFAASGDVQRHIIIHSGEKPHLCDICGRGFSNFSNLKEHKKTHTADKVFTCDECGKSFNMQRKLVKHRIRHTGERPYSCSACGKCFGGSGDLRRHVRTHTGEKPYTCEICNKCFTRSAVLRRHKKMHCKAGDESPDVLEELSQAIETSDLEKSQSSDSFSQDTSVTLMPVSVKLPVHPVENSVAEFDSHSGGSYCKLRSMIQPHGVSDQEKLSLDPGKLAKPQMQQTQPQAYAYSDVDTPAGGEPLQADGMAMIRSSLAALDNHGGDPLGSRASSTTYRNSEGQFFSSMTLWGLAMKTLQNENELDQ

SEQ ID NO: 15889 - protein, 677 aa, Homo Sapiens
MDFPGHFEQIFQQLNYQRLHGQLCDCVIVVGNRHFKAHRSVLAACSTHFRALFSVAEGDQTMNMIQLDSEVVTAEAFAALIDMMYTSTLMLGESNVMDVLLAASHLHLNSVVKACKHYLTTRTLPMSPPSERVQEQSARMQRSFMLQQLGLSIVSSALNSSQNGEEQPAPMSSSMRSNLDQRTPFPMRRLHKRKQSAEERARQRLRPSIDESAISDVTPENGPSGVHSREEFFSPDSLKIVDNPKADGMTDNQEDSAIMFDQSFGTQEDAQVPSQSDNSAGNMAQLSMASRATQVETSFDQEAAPEKSSFQCENPEVGLGEKEHMRVVVKSEPLSSPEPQDEVSDVTSQAEGSESVEVEGVVVSAEKIDLSPESSDRSFSDPQSSTDRVGDIHILEVTNNLEHKSTFSISNFLNKSRGNNFTANQNNDDNIPNTTSDCRLESEAPYLLSPEAGPAGGPSSAPGSHVENPFSEPADSHFVRPMQEVMGLPCVQTSGYQGGEQFGMDFSRSGLGLHSSFSRVMIGSPRGGASNFPYYRRIAPKMPVVTSVRSSQIPENSTSSQLMMNGATSSFENGHPSQPGPPQLTRASADVLSKCKKALSEHNVLVVEGARKYACKICCKTFLTLTDCKKHIRVHTGEKPYACLKCGKRFSQSSHLYKHSKTTCLRWQSSNLPSTLL

SEQ ID NO: 15890 - protein, 424 aa, Homo Sapiens
MAAESDVLHFQFEQQGDVVLQKMNLLRQQNLFCDVSIYINDTEFQGHKVILAACSTFMRDQFLLTQSKHVRITILQSAEVGRKLLLSCYTGALEVKRKELLKYLTAASYLQMVHIVEKCTEALSKYLEIDLSMKNNNQHTDLCQSSDPDVKNEDENSDKDCEIIEISEDSPVNIDFHVKEEESNALQSTVESLTSERKEMKSPELSTVDIGFKDNEICILHVESISTAGVENGQFSQPCTSSKASMYFSETQHSLINSTVESRVAEVPGNQDQGLFCENTEGSYGTVSEIQNLEEGYSLRHQCPRCPRGFLHVENYLRHLKMHKLFLCLQCGKTFTQKKNLNRHIRGHMGIRPFQCTVCLKTFTAKSTLQDHLNIHSGDRPYKCHCCDMDFKHKSALKKHLTSVHGRSSGEKLSRPDLKRQSLL

SEQ ID NO: 15891 - protein, 584 aa, Homo Sapiens
MAGGVDGPIGIPFPDHSSDILSGLNEQRTQGLLCDVVILVEGREFPTHRSVLAACSQYFKKLFTSGAVVDQQNVYEIDFVSAEALTALMDFAYTATLTVSTANVGDILSAARLLEIPAVSHVCADLLDRQILAADAGADAGQLDLVDQIDQRNLLRAKEYLEFFQSNPMNSLPPAAAAAAASFPWSAFGASDDDLDATKEAVAAAVAAVAAGDCNGLDFYGPGPPAERPPTGDGDEGDSNPGLWPERDEDAPTGGLFPPPVAPPAATQNGHYGRGGEEEAASLSEAAPEPGDSPGFLSGAAEGEDGDGPDVDGLAASTLLQQMMSSVGRAGAAAGDSDEESRADDKGVMDYYLKYFSGAHDGDVYPAWSQKVEKKIRAKAFQKCPICEKVIQGAGKLPRHIRTHTGEKPYECNICKVRFTRQDKLKVHMRKHTGEKPYLCQQCGAAFAHNYDLKNHMRVHTGLRPYQCDSCCKTFVRSDHLHRHLKKDGCNGVPSRRGRKPRVRGGAPDPSPGATATPGAPAQPSSPDARRNGQEKHFKDEDEDEDVASPDGLGRLNVAGAGGGGDSGGGPGAATDGNFTAGLA

SEQ ID NO: 15892 - protein, 539 aa, Homo Sapiens; identical to SEQ ID NO: 15784

SEQ ID NO: 15893 - protein, 619 aa, Homo Sapiens
MANDIDELIGIPFPNHSSEVLCSLNEQRHDGLLCDVLLVVQEQEYRTHRSVLAACSKYFKKLFTAGTLASQPYVYEIDFVQPEALAAILEFAYTSTLTITAGNVKHILNAARMLEIQCIVNVCLEIMEPGGDGGEEDDKEDDDDDEDDDDEEDEEEEEEEEEDDDDDTEDFADQENLPDPQDISCHQSPSKTDHLTEKAYSDTPRDFPDSFQAGSPGHLGVIRDFSIESLLRENLYPKANIPDRRPSLSPFAPDFFPHLWPGDFGAFAQLPEQPMDSGPLDLVIKNRKIKEEEKEELPPPPPPPFPNDFFKDMFPDLPGGPLGPIKAENDYGAYLNFLSATHLGGLFPPWPLVEERKLKPKASQQCPICHKVIMGAGKLPRHMRTHTGEKPYMCTICEVRFTRQDKLKIHMRKHTGERPYLCIHCNAKFVHNYDLKNHMRIHTGVRPYQCEFCYKSFTRSDHLHRHIKRQSCRMARPRRGRKPAAWRAASLLFGPGGPAPDKAAFVMPPALGEVGGHLGGAAVCLPGPSPAKHFLAAPKGALSLQELERQFEETQMKLFGRAQLEAERNAGGLLAFALAENVAAARPYFPLPDPWAAGLAGLPGLAGLNHVASMSEANN

SEQ ID NO: 15894 - protein, 441 aa, Homo Sapiens
MEISSHQSHLLQQLNEQRRQDVFCDCSILVEGKVFKAHRNVLFASSGYFKMLLSQNSKETSQPTTATFQAFSPDTFTVILDFVYSGKLSLTGQNVIEVMSAASFLQMTDVISVCKTFIKSSLDISEKEKDRYFSLSDKDANSNGVERSSFYSGGWQEGSSSPRSHLSPEQGTGIISGKSWNKYNYHPASQKNTQQPLAKHEPRKESIKKTKHLRLSQPSEVTHYKSSKREVRTSDSSSHVSQSEEQAQIDAEMDSTPVGYQYGQGSDVTSKSFPDDLPRMRFKCPYCTHVVKRKADLKRHLRCHTGERPYPCQACGKRFSRLDHLSSHFRTIHQACKLICRKCKRHVTDLTGQVVQEGTRRYRLCNECLAEFGIDSLPIDLEAEQHLMSPSDGDKDSRWHLSEDENRSYVEIVEDGSGDLVIQQVDDSEEEEEKEIKPNIR

SEQ ID NO: 15895 - protein, 473 aa, Homo Sapiens
METPTPLPPVPASPTCNPAPRTIQIEFPQHSSSLLESLNRHRLEGKFCDVSLLVQGRELRAHKAVLAAASPYFHDKLLLGDAPRLTLPSVIEADAFEGLLQLIYSGRLRLPLDALPAHLLVASGLQMWQVVDQCSEILRELETSGGGISARGGNSYHALLSTTSSTGGWCIRSSPFQTPVQSSASTESPASTESPVGGEGSELGEVLQIQVEEEEEEEEDDDDEDQGSATLSQTPQPQRVSGVFPRPHGPHPLPMTATPRKLPEGESAPLELPAPPALPPKIFYIKQEPFEPKEEISGSGTQPGGAKEETKVFSGGDTEGNGELGFLLPSGPGPTSGGGGPSWKPVDLHGNEILSGGGGPGGAGQAVHGPVKLGGTPPADGKRFGCLCGKRFAVKPKRDRHIMLTFSLRPFGCGICNKRFKLKHHLTEHMKTHAGALHACPHCGRRFRVHACFLRHRDLCKGQGWATAHWTYK

SEQ ID NO: 15896 - protein, 434 aa, Homo Sapiens
MPDRDSYANGTGSSGGGPGGGGSEEASGAGVGSGGASSDAICRDFLRNVCKRGKRCRYRHPDMSEVSNLGVSKNEFIFCHDFQNKECSRPNCRFIHGSKEDEDGYKKTGELPPRLRQKVAAGLGLSPADLPNGKEEVPICRDFLKGDCQRGAKCKFRHLQRDFEFDARGGGGTGGGSTGSVLPGRRHDLYDIYDLPDRGFEDHEPGPKRRRGGCCPPDGPHFESYEYSLAPPRGVECRLLEEENAMLRKRVEELKKQVSNLLATNEVLLEQNAQFRNQAKVITLSSTAPATEQTLAPTVGTVATFNHGIAQTHTTLSSQALQPRPVSQQELVAPAGAPAAPPTNAAPPAAPPPPPPHLTPEITPLSAALAQTIAQGMAPPPVSMAPVAVSVAPVAPVAVSMAQPLAGITMSHTTTPMVTYPIASQSMRITAMPH

SEQ ID NO: 15897 - protein, 810 aa, Homo Sapiens
MPNQGEDCYFFFYSTCTKGDSCPFRHCEAAIGNETVCTLWQEGRCFRQVCRFRHMEIDKKRSEIPCYWENQPTGCQKLNCAFHHNRGRYVDGLFLPPSKTVLPTVPESPEEEVKASQLSVQQNKLSVQSNPSPQLRSVMKVESSENVPSPTHPPVVINAADDDEDDDDQFSEEGDETKTPTLQPTPEVHNGLRVTSVRKPAVNIKQGECLNFGIKTLEEIKSKKMKEKSKKQGEGSSGVSSLLLHPEPVPGPEKENVRTVVRTVTLSTKQGEEPLVRLSLTERLGKRKFSAGGDSDPPLKRSLAQRLGKKVEAPETNIDKTPKKAQVSKSLKERLGMSADPDNEDATDKVNKVGEIHVKTLEEILLERASQKRGELQTKLKTEGPSKTDDSTSGARSSSTIRIKTFSEVLAEKKHRQQEAERQKSKKDTTCIKLKIDSEIKKTVVLPPIVASRGQSEEPAGKTKSMQEVHIKTLEEIKLEKALRVQQSSESSTSSPSQHEATPGARRLLRITKRTGMKEEKNLQEGNEVDSQSSIRTEAKEASGETTGVDITKIQVKRCETMREKHMQKQQEREKSVLTPLRGDVASCNTQVAEKPVLTAVPGITRHLTKRLPTKSSQKVEVETSGIGDSLLNVKCAAQTLEKRGKAKPKVNVKPSVVKVVSSPKLAPKRKAVEMHAAVIAAVKPLSSSSVLQEPPAKKAAVAVVPLVSEDKSVTVPEAENPRDSLVLPPTQSSSDSSPPEVSGPSSSQMSMKTRRLSSASTGKPPLSVEDDFEKLIWEISGGKLEAEIDLDPGKDEDDLLLELSEMIDS

SEQ ID NO: 15898 - protein, 599 aa, Homo Sapiens
MSGPCGEKPVLEASPTMSLWEFEDSHSRQGTPRPGQELAAEEASALELQMKVDFFRKLGYSSTEIHSVLQKLGVQADTNTVLGELVKHGTATERERQTSPDPCPQLPLVPRGGGTPKAPNLEPPLPEEEKEGSDLRPVVIDGSNVAMSHGNKEVFSCRGILLAVNWFLERGHTDITVFVPSWRKEQPRPDVPITDQHILRELEKKKILVFTPSRRVGGKRVVCYDDRFIVKLAYESDGIVVSNDTYRDLQGERQEWKRFIEERLLMYSFVNDKFMPPDDPLGRHGPSLDNFLRKKPLTLEHRKQPCPYGRKCTYGIKCRFFHPERPSCPQRSVADELRANALLSPPRAPSKDKNGRRPSPSSQSSSLLTESEQCSLDGKKLGAQASPGSRQEGLTQTYAPSGRSLAPSGGSGSSFGPTDWLPQTLDSLPYVSQDCLDSGIGSLESQMSELWGVRGGGPGEPGPPRAPYTGYSPYGSELPATAAFSAFGRAMGAGHFSVPADYPPAPPAFPPREYWSEPYPLPPPTSVLQEPPVQSPGAGRSPWGRAGSLAKEQASVYTKLCGVFPPHLVEAVMGRFPQLLDPQQLAAEILSYKSQHPSE

SEQ ID NO: 15899 - protein, 836 aa, Homo Sapiens
MTATAEVETPKMEKSASKEEKQQPKQDSTEQGNADSEEWMSSESDPEQISLKSSDNSKSCQPRDGQLKKKEMHSKPHRQLCRSPCLDRPSFSQSSILQDGKLDLEKEYQAKMEFALKLGYAEEQIQSVLNKLGPESLINDVLAELVRLGNKGDSEGQINLSLLVPRGPSSREIASPELSLEDEIDNSDNLRPVVIDGSNVAMSHGNKEEFSCRGIQLAVDWFLDKGHKDITVFVPAWRKEQSRPDAPITDQDILRKLEKEKILVFTPSRRVQGRRVVCYDDRFIVKLAFDSDGIIVSNDNYRDLQVEKPEWKKFIEERLLMYSFVNDKFMPPDDPLGRHGPSLENFLRKRPIVPEHKKQPCPYGKKCTYGHKCKYYHPERANQPQRSVADELRISAKLSTVKTMSEGTLAKCGTGMSSAKGEITSEVKRVAPKRQSDPSIRSVAMEPEEWLSIARKPEASSVPSLVTALSVPTIPPPKSHAVGALNTRSASSPVPGSSHFPHQKASLEHMASMQYPPILVTNSHGTPISYAEQYPKFESMGDHGYYSMLGDFSKLNINSMHNREYYMAEVDRGVYARNPNLCSDSRVSHTRNDNYSSYNNVYLAVADTHPEGNLKLHRSASQNRLQPFPHGYHEALTRVQSYGPEDSKQGPHKQSVPHLALHAQHPSTGTRSSCPADYPMPPNIHPGATPQPGRALVMTRMDSISDSRLYESNPVRQRRPPLCREQHASWDPLPCTTDSYGYHSYPLSNSLMQPCYEPVMVRSVPEKMEQLWRNPWVGMCNDSREHMIPEHQYQTYKNLCNIFPSNIVLAVMEKNPHTADAQQLAALIVAKLRAAR

SEQ ID NO: 15900 - protein, 1668 aa, Homo Sapiens
MSKIRRKVTVENTKTISDSTSRRPSVFERLGPSTGSTAETQCRNWLKTGNCLYGNTCRFVHGPSPRGKGYSSNYRRSPERPTGDLRERMKNKRQDVDTEPQKRNTEESSSPVRKESSRGRHREKEDIKITKERTPESEEENVEWETNRDDSDNGDINYDYVHELSLEMKRQKIQRELMKLEQENMEKREEIIIKKEVSPEVVRSKLSPSPSLRKSSKSPKRKSSPKSSSASKKDRKTSAVSSPLLDQQRNSKTNQSKKKGPRTPSPPPPIPEDIALGKKYKEKYKVKDRIEEKTRDGKDRGRDFERQREKRDKPRSTSPAGQHHSPISSRHHSSSSQSGSSIQRHSPSPRRKRTPSPSYQRTLTPPLRRSASPYPSHSLSSPQRKQSPPRHRSPMREKGRHDHERTSQSHDRRHERREDTRGKRDREKDSREEREYEQDQSSSRDHRDDREPRDGRDRRDARDTRDRRELRDSRDMRDSREMRDYSRDTKESRDPRDSRSTRDAHDYRDREGRDTHRKEDTYPEESRSYGRNHLREESSRTEIRNESRNESRSEIRNDRMGRSRGRVPELPEKGSRGSRGSQIDSHSSNSNYHDSWETRSSYPERDRYPERDNRDQARDSSFERRHGERDRRDNRERDQRPSSPIRHQGRNDELERDERREERRVDRVDDRRDERARERDRERERDRERERERERERDREREKERELERERAREREREREKERDRERDRDRDHDRERERERERDREKEREREREERERERERERERERERERERERARERDKERERQRDWEDKDKGRDDRREKREEIREDRNPRDGHDERKSKKRYRNEGSPSPRQSPKRRREHSPDSDAYNSGDDKNEKHRLLSQVVRPQESRSLSPSHLTEDRQGRWKEEDRKPERKESSRRYEEQELKEKVSSVDKQREQTEILESSRMRAQDIIGHHQSEDRETSDRAHDENKKKAKIQKKPIKKKKEDDVGIERGNIETTSEDGQVFSPKKGQKKKSIEKKRKKSKGDSDISDEEAAQQSKKKRGPRTPPITTKEELVEMCNGKNGILEDSQKKEDTAFSDWSDEDVPDRTEVTEAEHTATATTPGSTPSPLSSLLPPPPPVATATATTVPATLAATTAAAATSFSTSAITISTSATPTNTTNNTFANEDSHRKCHRTRVEKVETPHVTIEDAQHRKPMDQKRSSSLGSNRSNRSHTSGRLRSPSNDSAHRSGDDQSGRKRVLHSGSRDREKTKSLEITGERKSRIDQLKRGEPSRSTSSDRQDSRSHSSRRSSPESDRQVHSRSGSFDSRDRLQERDRYEHDRERERERRDTRQREWDRDADKDWPRNRDRDRLRERERERERDKRRDLDRERERLISDSVERDRDRDRDRTFESSQIESVKRCEAKLEGEHERDLESTSRDSLALDKERMDKDLGSVQGFEETNKSERTESLEGDDESKLDDAHSLGSGAGEGYEPISDDELDEILAGDAEKREDQQDEEKMPDPLDVIDVDWSGLMPKHPKEPREPGAALLKFTPGAVMLRVGISKKLAGSELFAKVKETCQRLLEKPKDADNLFEHELGALNMAALLRKEERASLLSNLGPCCKALCFRRDSAIRKQLVKNEKGTIKQAYTSAPMVDNELLRLSLRLFKRKTTCHAPGHEKTEDNKLSQSSIQQELCVS

SEQ ID NO: 15901 - protein, 736 aa, Homo Sapiens
MEIGTEISRKIRSAIKGKLQELGAYVDEELPDYIMVMVANKKSQDQMTEDLSLFLGNNTIRFTVWLHGVLDKLRSVTTEPSSLKSSDTNIFDSNVPSNKSNFSRGDERRHEAAVPPLAIPSARPEKRDSRVSTSSQESKTTNVRQTYDDGAATRLMSTVKPLREPAPSEDVIDIKPEPDDLIDEDLNFVQENPLSQKKPTVTLTYGSSRPSIEIYRPPASRNADSGVHLNRLQFQQQQNSIHAAKQLDMQSSWVYETGRLCEPEVLNSLEETYSPFFRNNSEKMSMEDENFRKRKLPVVSSVVKVKKFNHDGEEEEEDDDYGSRTGSISSSVSVPAKPERRPSLPPSKQANKNLILKAISEAQESVTKTTNYSTVPQKQTLPVAPRTRTSQEELLAEVVQGQSRTPRISPPIKEEETKGDSVEKNQGTQQRQLLSRLQIDPVMAETLQMSQDYYDMESMVHADTRSFILKKPKLSEEVVVAPNQESGMKTADSLRVLSGHLMQTRDLVQPDKPASPKFIVTLDGVPSPPGYMSDQEEDMCFEGMKPVNQTAASNKGLRGLLHPQQLHLLSRQLEDPNGSFSNAEMSELSVAQKPEKLLERCKYWPACKNGDECAYHHPISPCKAFPNCKFAEKCLFVHPNCKYDAKCTKPDCPFTHVSRRIPVLSPKPAVAPPAPPSSSQLCRYFPACKKMECPFYHPKHCRFNTQCTRPDCTFYHPTINVPPRHALKWIRPQTSE

SEQ ID NO: 15902 - protein, 426 aa, Homo Sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESFLAWKKRKRQEKIDKLEQDMERRKADFKAGKALVISGREVFEFRPELVNDDDEEADDTRYTQGTGGDEVDDSVSVNDIDLSLYIPRDVDETGITVASLERFSTYTSDKDENKLSEASGGRAENGERSDLEEDNEREGTENGAIDAVPVDENLFTGEDLDELEEELNTLDLEE

SEQ ID NO: 15903 - protein, 953 aa, Homo Sapiens
MDVAESPERDPHSPEDEEQPQGLSDDDILRDSGSDQDLDGAGVRASDLEDEESAARGPSQEEEDNHSDEEDRASEPKSQDQDSEVNELSRGPTSSPCEEEGDEGEEDRTSDLRDEASSVTRELDEHELDYDEEVPEEPAPAVQEDEAEKAGAEDDEEKGEGTPREEGKAGVQSVGEKESLEAAKEKKKEDDDGEIDDGEIDDDDLEEGEVKDPSDRKVRPRPTCRFFMKGNCTWGMNCRFIHPGVNDKGNYSLITKADPFPPNGAPPLGPHPLMPANPWGGPVVDEILPPPPPEPPTESAWERGLRHAKEVLKKATIRKEQEPDFEEKRFTVTIGEDEREFDKENEVFRDWNSRIPRDVRDTVLEPYADPYYDYEIERFWRGGQYENFRVQYTETEPYHNYRERERERERENRQRERERERERDRERERRQRERERERERERDKERQRRKEEWERERAKRDEKDRQHRDRDREKEREKEKGKPKPRSPQPPSRQAEPPKKEAATTGPQVKRADEWKDPWRRSKSPKKKLGVSVSPSRARRRRKTSASSASASNSSRSSSRSSSYSGSGSSRSRSRSSSYSSYSSRSSRHSSFSGSRSRSRSFSSSPSPSPTPSPHRPSIRTKGEPAPPPGKAGEKSVKKPAPPPAPPQATKTTAPVPEPTKPGDPREARRKERPARTPPRRRTLSGSGSGSGSSYSGSSSRSRSLSVSSVSSVSSATSSSSSAHSVDSEDMYADLASPVSSASSRSPAPAQTRKEKGKSKKEDGVKEEKRKRDSSTQPPKSAKPPAGGKSSQQPSTPQQAPPGQPQQGTFVAHKEIKLTLLNKAADKGSRKRYEPSDKDRQSPPPAKRPNTSPDRGSRDRKSGGRLGSPKPERQRGQNSKAPAAPADRKRQLSPQSKSSSKVTSVPGKASDPGAASTKSGKASTLSRREELLKQLKAVEDAIARKRAKIPGKA

SEQ ID NO: 15904 - protein, 948 aa, Homo Sapiens
MEEKEILRRQIRLLQGLIDDYKTLHGNAPAPGTPAASGWQPPTYHSGRAFSARYPRPSRRGYSSHHGPSWRKKYSLVNRPPGPSDPPADHAVRPLHGARGGQPPVPQQHVLERQVQLSQGQNVVIKVKPPSKSGSASASGAQRGSLEEFEETPWSDQRPREGEGEPPRGQLQPSRPTRARGTCSVEDPLLVCQKEPGKPRMVKSVGSVGDSPREPRRTVSESVIAVKASFPSSALPPRTGVALGRKLGSHSVASCAPQLLGDRRVDAGHTDQPVPSGSVGGPARPASGPRQAREASLVVTCRTNKFRKNNYKWVAASSKSPRVARRALSPRVAAENVCKASAGMANKVEKPQLIADPEPKPRKPATSSKPGSAPSKYKWKASSPSASSSSSFRWQSEASSKDHASQLSPVLSRSPSGDRPAVGHSGLKPLSGETPLSAYKVKSRTKIIRRRSSTSLPGDKKSGTSPAATAKSHLSLRRRQALRGKSSPVLKKTPNKGLVQVTTHRLCRLPPSRAHLPTKEASSLHAVRTAPTSKVIKTRYRIVKKTPASPLSAPPFPLSLPSWRARRLSLSRSLVLNRLRPVASGGGKAQPGSPWWRSKGYRCIGGVLYKVSANKLSKTSGQPSDAGSRPLLRTGRLDPAGSCSRSLASRAVQRSLAIIRQARQRREKRKEYCMYYNRFGRCNRGERCPYIHDPEKVAVCTRFVRGTCKKTDGTCPFSHHVSKEKMPVCSYFLKGICSNSNCPYSHVYVSRKAEVCSDFLKGYCPLGAKCKKKHTLLCPDFARRGACPRGAQCQLLHRTQKRHSRRAATSPAPGPSDATARSRVSASHGPRKPSASQRPTRQTPSSAALTAAAVAAPPHCPGGSASPSSSKASSSSSSSSSPPASLDHEAPSLQEAALAAACSNRLCKLPSFISLQSSPSPGAQPRVRAPRAPLTKDSGKPLHIKPRL

SEQ ID NO: 15905 - protein, 1303 aa, Homo Sapiens
MEAAPGTPPPPPSESPPPPSPPPPSTPSPPPCSPDARPATPHLLHHRLPLPDDREDGELEEGELEDDGAEETQDTSGGPERSRKEKGEKHHSDSDEEKSHRRLKRKRKKEREKEKRRSKKRRKSKHKRHASSSDDFSDFSDDSDFSPSEKGHRKYREYSPPYAPSHQQYPPSHATPLPKKAYSKMDSKSYGMYEDYENEQYGEYEGDEEEDMGKEDYDDFTKELNQYRRAKEGSSRGRGSRGRGRGYRGRGSRGGSRGRGMGRGSRGRGRGSMGGDHPEDEEDFYEEEMDYGESEEPMGDDDYDEYSKELNQYRRSKDSRGRGLSRGRGRGSRGRGKGMGRGRGRGGSRGGMNKGGMNDDEDFYDEDMGDGGGGSYRSRDHDKPHQQSDKKGKVICKYFVEGRCTWGDHCNFSHDIELPKKRELCKFYITGFCARAENCPYMHGDFPCKLYHTTGNCINGDDCMFSHDPLTEETRELLDKMLADDAEAGAEDEKEVEELKKQGINPLPKPPPGVGLLPTPPRPPGPQAPTSPNGRPMQGGPPPPPPPPPPPPGPPQMPMPVHEPLSPQQLQQQDMYNKKIPSLFEIVVRPTGQLAEKLGVRFPGPGGPPGPMGPGPNMGPPGPMGGPMHPDMHPDMHPDMHPDMHADMHADMPMGPGMNPGPPMGPGGPPMMPYGPGDSPHSGMMPPIPPAQNFYENFYQQQEGMEMEPGLLGDAEDYGHYEELPGEPGEHLFPEHPLEPDSFSEGGPPGRPKPGAGVPDFLPSAQRALYLRIQQKQQEEEERARRLAESSKQDRENEEGDTGNWYSSDEDEGGSSVTSILKTLRQQTSSRPPASVGELSSSGLGDPRLQKGHPTGSRLADPRLSRDPRLTRHVEASGGSGPGDSGPSDPRLARALPTSKPEGSLHSSPVGPSSSKGSGPPPTEEEEGERALREKAVNIPLDPLPGHPLRDPRSQLQQFSHIKKDVTLSKPSFARTVLWNPEDLIPLPIPKQDAVPPVPAALQSMPTLDPRLHRAATAGPPNARQRPGASTDSSTQGANLPDFELLSRILKTVNATGSSAAPGSSDKPSDPRVRKAPTDPRLQKPTDSTASSRAAKPGPAEAPSPTASPSGDASPPATAPYDPRVLAAGGLGQGGGGGQSSVLSGISLYDPRTPNAGGKATEPAADTGAQPKGAEGNGKSSASKAKEPPFVRKSALEQPETGKAGADGGTPTDRYNSYNRPRPKAAAAPAATTATPPPEGAPPQPGVHNLPVPTLFGTVKQTPKTGSGSPFAGNSPAREGEQDAASLKDVFKGFDPTASPFCQ

SEQ ID NO: 15906 - protein, 1189 aa, Homo Sapiens
MTDSEHAGHDREDGELEDGEIDDAGFEEIQEKEAKENEKQKSEKAYRKSRKKHKKEREKKKSKRRKREKHKHNSPSSDDSSDYSLDSDVEHTESSHKKRTGFYRDYDIPFTQRGHISGSYITSKKGQHNKKFKSKEYDEYSTYSDDNFGNYSDDNFGNYGQETEEDFANQLKQYRQAKETSNIALGSSFSKESGKKQRMKGVQQGIEQRVKSFNVGRGRGLPKKIKRKERGGRTNKGPNVFSVSDDFQEYNKPGKKWKVMTQEFINQHTVEHKGKQICKYFLEGRCIKGDQCKFDHDAELEKRKEICKFYLQGYCTKGENCIYMHNEFPCKFYHSGAKCYQGDNCKFSHDDLTKETKKLLDKVLNTDEELINEDERELEELRKRGITPLPKPPPGVGLLPTPPEHFPFSDPEDDFQTDFSDDFRKIPSLFEIVVKPTVDLAHKIGRKPPAFYTSASPPGPQFQGSSPHPQHIYSSGSSPGPGPNMSQGHSSPVMHPGSPGHHPCAGPPGLPVPQSPPLPPGPPEIVGPQNQAGVLVQPDTSLTPPSMGGAYHSPGFPGHVMKVPRENHCSPGSSYQQSPGEMQLNTNYESLQNPAEFYDNYYAQHSIHNFQPPNNSGDGMWHGEFAQQQPPVVQDSPNHGSGSDGSSTRTGHGPLPVPGLLPAVQRALFVRLTQRYQEDEEQTSTQPHRAPSKEEDDTVNWYSSSEEEEGSSVKSILKTLQKQTETLRNQQQPSTELSTPTDPRLAKEKSKGNQVVDPRLRTIPRQDIRKPSESAPLDLRLAWDPRKLRGNGSGHIGSSVGGAKFDLHHANAGTNVKHKRGDDDDEDTERELREKAFLIPLDASPGIMLQDPRSQLRQFSHIKMDITLTKPNFAKHIVWAPEDLLPVPLPKPDPVSSINLPLPPLIADQRLNRLWNTKSDLHQNTVSIDPKLAAKAKINTTNREGYLEQFGDSHGSGAKLGDPRLQKNFDPRLHRLPNTESHQVVMKDSHASKGAPHLPRSNPGSSQPSGAGTSNSGSGALPPYAPKLSSSAGLPLGTSTSVLSGISLYDPRDHGSSSTSELATASSGENSKNQKKSGGLKSSDKTEPSPGEAILPQKPSPNVGVTLEGPADPQADVPRSSGKVQVPAVHSLPVQALTGLIRPQYSDPRQARQPGQGSPTPDNDPGRETDDKSLKEVFKTFDPTASPFC

SEQ ID NO: 15907 - protein, 971 aa, Homo Sapiens
MSNVSEERRKRQQNIKEGLQFIQSPLSYPGTQEQYAVYLRALVRNLFNEGNDVYREHDWNNSISQYTEALNIADYAKSEEILIPKEIIEKLYINRIACYSNMGFHDKVLEDCNIVLSLNASNCKALYRKSKALSDLGRYKKAYDAVAKCSLAVPQDEHVIKLTQELAQKLGFKIRKAYVRAELSLKSVPGDGATKALNHSVEDIEPDLLTPRQEAVPVVSLPAPSFSHEVGSELASVPVMPLTSILPLQVEESALPSAVLANGGKMPFTMPEAFLDDGDMVLGDELDDLLDSAPETNETVMPSALVRGPLQTASVSPSMPFSASLLGTLPIGARYAPPPSFSEFYPPLTSSLEDFCSSLNSFSMSESKRDLSTSTSREGTPLNNSNSSLLLMNGPGSLFASENFLGISSQPRNDFGNFFGSAVTKPSSSVTPRHPLEGTHELRQACQICFVKSGPKLMDFTYHANIDHKCKKDILIGRIKNVEDKSWKKIRPRPTKTNYEGPYYICKDVAAEEECRYSGHCTFAYCQEEIDVWTLERKGAFSREAFFGGNGKINLTVFKLLQEHLGEFIFLCEKCFDHKPRMISKRNKDNSTACSHPVTKHEFEDNKCLVHILRETTVKYSKIRSFHGQCQLDLCRHEVRYGCLREDECFYAHSLVELKVWIMQNETGISHDAIAQESKRYWQNLEANVPGAQVLGNQIMPGFLNMKIKFVCAQCLRNGQVIEPDKNRKYCSAKARHSWTKDRRAMRVMSIERKKWMNIRPLPTKKQMPLQFDLCNHIASGKKCQYVGNCSFAHSPEEREVWTYMKENGIQDMEQFYELWLKSQKNEKSEDIASQSNKENGKQIHMPTDYAEVTVDFHCWMCGKNCNSEKQWQGHISSEKHKEKVFHTEDDQYCWQHRFPTGYFSICDRYMNGTCPEGNSCKFAHGNAELHEWEERRDALKMKLNKARKDHLIGPNDNDFGKYSFLFKDLN

SEQ ID NO: 15908 - protein, 993 aa, Homo Sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETGNVPDTREQVEIGAPRDCYVDPRGSPALLPSTPTMPLFPHVLDLLAPLDSSRTLPSTDSLDDFSDGDVFGPELDTLLDSLSLVQGGLSGSGVPSELPQLIPVFPGGTPLLPPVVGGSIPVSSPLPPASFGLVMDPSKKLAASVLDALDPPGPTLDPLDLLPYSETRLDALDSFGSTRGSLDKPDSFMEETNSQDHRPPSGAQKPAPSPEPCMPNTALLIKNPLAATHEFKQACQLCYPKTGPRAGDYTYREGLEHKCKRDILLGRLRSSEDQTWKRIRPRPTKTSFVGSYYLCKDMINKQDCKYGDNCTFAYHQEEIDVWTEERKGTLNRDLLFDPLGGVKRGSLTIAKLLKEHQGIFTFLCEICFDSKPRIISKGTKDSPSVCSNLAAKHSFYNNKCLVHIVRSTSLKYSKIRQFQEHFQFDVCRHEVRYGCLREDSCHFAHSFIELKVWLLQQYSGMTHEDIVQESKKYWQQMEAHAGKASSSMGAPRTHGPSTFDLQMKFVCGQCWRNGQVVEPDKDLKYCSAKARHCWTKERRVLLVMSKAKRKWVSVRPLPSIRNFPQQYDLCIHAQNGRKCQYVGNCSFAHSPEERDMWTFMKENKILDMQQTYDMWLKKHNPGKPGEGTPISSREGEKQIQMPTDYADIMMGYHCWLCGKNSNSKKQWQQHIQSEKHKEKVFTSDSDASGWAFRFPMGEFRLCDRLQKGKACPDGDKCRCAHGQEELNEWLDRREVLKQKLAKARKDMLLCPRDDDFGKYNFLLQEDGDLAGATPEAPAAAATATTGE

SEQ ID NO: 15909 - protein, 291 aa, Homo Sapiens [sequence omitted]

SEQ ID NO: 15910 - protein, 1644 aa, Homo Sapiens
MEESKTLKSENHEPKKNVICEESKAVQVIGNQTLKARNDKSVKEIENSSPNRNSSKKNKQNDICIEKTEVKSCKVNAANLPGPKDLGLVLRDQSHCKAKKFPNSPVKAEKATISQAKSEKATSLQAKAEKSPKSPNSVKAEKASSYQMKSEKVPSSPAEAEKGPSLLLKDMRQKTELQQIGKKIPSSFTSVDKVNIEAVGGEKCALQNSPRSQKQQTCTDNTGDSDDSASGIEDVSDDLSKMKNDESNKENSSEMDYLENATVIDESALTPEQRLGLKQAEERLERDHIFRLEKRSPEYTNCRYLCKLCLIHIENIQGAHKHIKEKRHKKNILEKQEESELRSLPPPSPAHLAALSVAVIELAKEHGITDDDLRVRQEIVEEMSKVITTFLPECSLRLYGSSLTRFALKSSDVNIDIKFPPKMNHPDLLIKVLGILKKNVLYVDVESDFHAKVPVVVCRDRKSGLLCRVSAGNDMACLTTDLLTALGKIEPVFIPLVLAFRYWAKLCYIDSQTDGGIPSYCFALMVMFFLQQRKPPLLPCLLGSWIEGFDPKRMDDFQLKGIVEEKFVKWECNSSSATEKNSIAEENKAKADQPKDDTKKTETDNQSNAMKEKHGKSPLALETPNRVSLGQLWLELLKFYTLDFALEEYVICVRIQDILTRENKNWPKRRIAIEDPFSVKRNVARSLNSQLVYEYVVERFRAAYRYFACPQTKGGNKSTVDFKKREKGKISNKKPVKSNNMATNGCILLGETTEKINAEREQPVQCDEMDCTSQRCIIDNNNLLVNELDFADHGQDSSSLSTSKSSEIEPKLDKKQDDLAPSETCLKKELSQCNCIDLSKSPDPDKSTGTDCRSNLETESSHQSVCTDTSATSCNCKATEDASDLNDDDNLPTQELYYVFDKFILTSGKPPTIVCSICKKDGHSKNDCPEDFRKIDLKPLPPMTNRFREILDLVCKRCFDELSPPCSEQHNREQILIGLEKFIQKEYDEKARLCLFGSSKNGFGFRDSDLDICMTLEGHENAEKLNCKEIIENLAKILKRHPGLRNILPITTAKVPIVKFEHRRSGLEGDISLYNTLAQHNTRMLATYAAIDPRVQYLGYTMKVFAKRCDIGDASRGSLSSYAYILMVLYFLQQRKPPVIPVLQEIFDGKQIPQRMVDGWNAFFFDKTEELKKRLPSLGKNTESLGELWLGLLRFYTEEFDFKEYVISIRQKKLLTTFEKQWTSKCIAIEDPFDLNHNLGAGVSRKMTNFIMKAFINGRKLFGTPFYPLIGREAEYFFDSRVLTDGELAPNDRCCRVCGKIGHYMKDCPKRKSLLFRLKKKDSEEEKEGNEEEKDSRDVLDPRDLHDTRDFRDPRDLRCFICGDAGHVRRECPEVKLARQRNSSVAAAQLVRNLVNAQQVAGSAQQQGDQSIRTRQSSECSESPSYSPQPQPFPQNSSQSAAITQPSSQPGSQPKLGPPQQGAQPPHQVQMPLYNFPQSPPAQYSPMHNMGLLPMHPLQIPAPSWPIHGPVIHSAPGSAPSNIGLNDPSIIFAQPAARPVAIPNTSHDGHWPRTVAPNSLVNSGAVGNSEPGFRGLTPPIPWEHAPRPHFPLVPASWPYGLHQNFMHQGNARFQPNKPFYTQDRCATRRCRERCPHPPRGNVSE

SEQ ID NO: 15911 - protein, 1495 aa, Homo Sapiens
MGDTAKPYFVKRTKDRGTMDDDDFRRGHPQQDYLIIDDHAKGHGSKMEKGLQKKKITPGNYGNTPRKGPCAVSSNPYAFKNPIYSQPAWMNDSHKDQSKRWLSDEHTGNSDNWREFKPGPRIPVINRQRKDSFQENEDGYRWQDTRGCRTVRRLFHKDLTSLETTSEMEAGSPENKKQRSRPRKPRKTRNEENEQDGDLEGPVIDESVLSTKELLGLQQAEERLKRDCIDRLKRRPRNYPTAKYTCRLCDVLIESIAFAHKHIKEKRHKKNIKEKQEEELLTTLPPPTPSQINAVGIAIDKVVQEFGLHNENLEQRLEIKRIMENVFQHKLPDCSLRLYGSSCSRLGFKNSDVNIDIQFPAIMSQPDVLLLVQECLKNSDSFIDVDADFHARVPVVVCREKQSGLLCKVSAGNENACLTTKHLTALGKLEPKLVPLVIAFRYWAKLCSIDRPEEGGLPPYVFALMAIFFLQQRKEPLLPVYLGSWIEGFSLSKLGNFNLQDIEKDVVIWEHTDSAAGDTGITKEEAPRETPIKRGQVSLILDVKHQPSVPVGQLWVELLRFYALEFNLADLVISIRVKELVSRELKDWPKKRIAIEDPYSVKRNVARTLNSQPVFEYILHCLRTTYKYFALPHKITKSSLLKPLNAITCISEHSKEVINHHPDVQTKDDKLKNSVLAQGPGATSSAANTCKVQPLTLKETAESFGSPPKEEMGNEHISVHPENSDCIQADVNSDDYKGDKVYHPETGRKNEKEKVGRKGKHLLTVDQKRGEHVVCGSTRNNESESTLDLEGFQNPTAKECEGLATLDNKADLDGESTEGTEELEDSLNHFTHSVQGQTSEMIPSDEEEEDDEEEEEEEEPRLTINQREDEDGMANEDELDNTYTGSGDEDALSEEDDELGEAAKYEDVKECGKHVERALLVELNKISLKEENVCEEKNSPVDQSDFFYEFSKLIFTKGKSPTVVCSLCKREGHLKKDCPEDFKRIQLEPLPPLTPKFLNILDQVCIQCYKDFSPTIIEDQAREHIRQNLESFIRQDFPGTKLSLFGSSKNGFGFKQSDLDVCMTINGLETAEGLDCVRTIEELARVLRKHSGLRNILPITTAKVPIVKFFHLRSGLEVDISLYNTLALHNTRLLSAYSAIDPRVKYLCYTMKVFTKMCDIGDASRGSLSSYAYTLMVLYFLQQRNPPVIPVLQEIYKGEKKPEIFVDGWNIYFFDQIDELPTYWSECGKNTESVGQLWLGLLRFYTEEFDFKEHVISIRRKSLLTTFKKQWTSKYIVIEDPFDLNHNLGAGLSRKMTNFIMKAFINGRRVFGIPVKGFPKDYPSKMEYFFDPDVLTEGELAPNDRCCRICGKIGHFMKDCPMRRKVRRRRDQEDALNQRYPENKEKRSKEDKEIHNKYTEREVSTKEDKPIQCTPQKAKPMRAAADLGREKILRPPVEKWKRQDDKDLREKRCFICGREGHIKKECPQFKGSSGSLSSKYMTQGKASAKRTQQES

SEQ ID NO: 15912 - protein, 1124 aa, Homo Sapiens
MADGPRCKRRKQANPRRNNVTNYNTVVETNSDSDDEDKLHIVEEESVTDAADCEGVPEDDLPTDQTVLPGRSSEREGNAKNCWEDDRKEGQEILGPEAQADEAGCTVKDDECESDAENEQNHDPNVEEFLQQQDTAVIFPEAPEEDQRQGTPEASGHDENGTPDAFSQLLTCPYCDRGYKRFTSLKEHIKYRHEKNEDNFSCSLCSYTFAYRTQLERHMTSHKSGRDQRHVTQSGCNRKFKCTECGKAFKYKHHLKEHLRIHSGEKPYECPNCKKRFSHSGSYSSHISSKKCISLIPVNGRPRTGLKTSQCSSPSLSASPGSPTRPQIRQKIENKPLQEQLSVNQIKTEPVDYEFKPIVVASGINCSTPLQNGVFTGGGPLQATSSPQGMVQAVVLPTVGLVSPISINLSDIQNVLKVAVDGNVIRQVLENNQANLASKEQETINASPIQQGGHSVISAISLPLVDQDGTTKIIINYSLEQPSQLQVVPQNLKKENPVATNSCKSEKLPEDLTVKSEKDKSFEGGVNDSTCLLCDDCPGDINALPELKHYDLKQPTQPPPLPAAEAEKPESSVSSATGDGNLSPSQPPLKNLLSLLKAYYALNAQPSAEELSKIADSVNLPLDVVKKWFEKMQAGQISVQSSEPSSPEPGKVNIPAKNNDQPQSANANEPQDSTVNLQSPLKMTNSPVLPVGSTTNGSRSSTPSPSPLNLSSSRNTQGYLYTAEGAQEEPQVEPLDLSLPKQQGELLERSTITSVYQNSVYSVQEEPLNLSCAKKEPQKDSCVTDSEPVVNVIPPSANPINIAIPTVTAQLPTIVAIADQNSVPCLRALAANKQTILIPQVAYTYSTTVSPAVQEPPLKVIQPNGNQDERQDTSSEGVSNVEDQNDSDSTPPKKKMRKTENGMYACDLCDKIFQKSSSLLRHKYEHTGKRPHECGICKKAFKHKHHLIEHMRLHSGEKPYQCDKCGKRFSHSGSYSQHMNHRYSYCKREAEERDSTEQEEAGPEILSNEHVGARASPSQGDSDERESLTREEDEDSEKEEEEEDKEMEELQEEKECEKPQGDEEEEEEEEEVEEEEVEEAENEGEEAKTEGLMKDDRAESQASSLGQKVGESSEQVSEEKTNEA

SEQ ID NO: 15913 - protein, 1214 aa, Homo Sapiens
MKQPIMADGPRCKRRKQANPRRKNVVNYDNVVDTGSETDEEDKLHIAEDDGIANPLDQETSPASVPNHESSPHVSQALLPREEEEDEIREGGVEHPWHNNEILQASVDGPEEMKEDYDTMGPEATIQTAINNGTVKNANCTSDFEEYFAKRKLEERDGHAVSIEEYLQRSDTAIIYPEAPEELSRLGTPEANGQEENDLPPGTPDAFAQLLTCPYCDRGYKRLTSLKEHIKYRHEKNEENFSCPLCSYTFAYRTQLERHMVTHKPGTDQHQMLTQGAGNRKFKCTECGKAFKYKHHLKEHLRIHSGEKPYECPNCKKRFSHSGSYSSHISSKKCIGLISVNGRMRNNIKTGSSPNSVSSSPTNSAITQLRNKLENGKPLSMSEQTGLLKIKTEPLDFNDYKVLMATHGFSGTSPFMNGGLGATSPLGVHPSAQSPMQHLGVGMEAPLLGFPTMNSNLSEVQKVLQIVDNTVSRQKMDCKAEEISKLKGYHMKDPCSQPEEQGVTSPNIPPVGLPVVSHNGATKSIIDYTLEKVNEAKACLQSLTTDSRRQISNIKKEKLRTLIDLVTDDKMIENHNISTPFSCQFCKESFPGPIPLHQHERYLCKMNEEIKAVLQPHENIVPNKAGVFVDNKALLLSSVLSEKGMTSPINPYKDHMSVLKAYYAMNMEPNSDELLKISIAVGLPQEFVKEWFEQRKVYQYSNSRSPSLERSSKPLAPNSNPPTKDSLLPRSPVKPMDSITSPSIAELHNSVTNCDPPLRLTKPSHFTNIKPVEKLDHSRSNTPSPLNLSSTSSKNSHSSSYTPNSFSSEELQAEPLDLSLPKQMKEPKSIIATKNKTKASSISLDHNSVSSSSENSDEPLNLTFIKKEFSNSNNLDNKSTNPVFSMNPFSAKPLYTALPPQSAFPPATFMPPVQTSIPGLRPYPGLDQMSFLPHMAYTYPTGAATFADMQQRRKYQRKQGFQGELLDGAQDYMSGLDDMTDSDSCLSRKKIKKTESGMYACDLCDKTFQKSSSLLRHKYEHTGKRPHQCQICKKAFKHKHHLIEHSRLHSGEKPYQCDKCGKRFSHSGSYSQHMNHRYSYCKREAEEREAAEREAREKGHLEPTELLMNRAYLQSITPQGYSDSEERESMPRDGESEKEHEKEGEDGYGKLGRQDGDEEFEEEEEESENKSMDTDPETIRDEEETGDHSMDDSSEDGKMETKSDHEEDNMEDGM

SEQ ID NO: 15914 - protein, 1243 aa, Homo Sapiens
METRAAENTAIFMCKCCNLFSPNQSELLSHVSEKHMEEGVNVDEIIIPLRPLSTPEPPNSSKTGDEFLVMKRKRGRPKGSTKKSSTEEELAENIVSPTEDSPLAPEEGNSLPPSSLECSKCCRKFSNTRQLRKHICIIVLNLGEEEGEAGNESDLELEKKCKEDDREKASKRPRSQKTEKVQKISGKEARQLSGAKKPIISVVLTAHEAIPGATKIVPVEAGPPETGATNSETTSADLVPRRGYQEYAIQQTPYEQPMKSSRLGPTQLKIFTCEYCNKVFKFKHSLQAHLRIHTNEKPYKCPQCSYASAIKANLNVHLRKHTGEKFACDYCSFTCLSKGHLKVHIERVHKKIKQHCRFCKKKYSDVKNLIKHIRDAHDPQDKKVKEALDELCLMTREGKRQLLYDCHICERKFKNELDRDRHMLVHGDKWPFACELCGHGATKYQALELHVRKHPFVYVCAVCRKKFVSSIRLRTHIKEVHGAAQEALVFTSSINQSFCLLEPGGDIQQEALGDQLQLVEEEFALQGVNALKEEACPGDTQLEEGRKEPEAPGEMPAPAVHLASPQAESTALPPCELETTVVSSSDLHSQEVVSDDFLLKNDTSSAEAHAAPEKPPDMQHRSSVQTQGEVITLLLSKAQSAGSDQESHGAQSPLGEGQNMAVLSAGDPDPSRCLRSNPAEASDLLPPVAGGGDTITHQPDSCKAAPEHRSGITAFMKVLNSLQKKQMNTSLCERIRKVYGDLECEYCGKLFWYQVHFDMHVRTHTREHLYYCSQCHYSSITKNCLKRHVIQKHSNILLKCPTDGCDYSTPDKYKLQAHLKVHTALDKRSYSCPVCEKSFSEDRLIKSHIKTNHPEVSMSTISEVLGRRVQLKGLIGKRAMKCPYCDFYFMKNGSDLQRHIWAHEGVKPFKCSLCEYATRSKSNLKAHMNRHSTEKTHLCDMCGKKFKSKGTLKSHKLLHTADGKQFKCTVCDYTAAQKPQLLRHMEQHVSFKPFRCAHCHYSCNISGSLKRHYNRKHPNEEYANVGTGELAAEVLIQQGGLKCPVCSFVYGTKWEFNRHLKNKHGLKVVEIDGDPKWETATEAPEEPSTQYLHITEAEEDVQGTQAAVAALQDLRYTSESGDRLDPTAVNILQQIIELGAETHDATALASVVAMAPGTVTVVKQVTEEEPSSNHTVMIQETVQQASVELAEQHHLVVSSDDVEGIETVTVYTQGGEASEFIVYVQEAMQPVEEQAVEQPAQEL

SEQ ID NO: 15915 - protein, 2572 aa, Homo Sapiens
MATLNSASTTGTTPSPGHNAPSLPSDTFSSSTPSDPVTKDPPAASSTSENMRSSEPGGQLLESGCGLVPPKEIGEPQEGPDCGHFPPNDPGVEKDKEQEEEEEGLPPMDLSNHLFFTAGGEAYLVAKLSLPGGSELLLPKGFPWGEAGIKEEPSLPFLAYPPPSHLTALHIQHGFDPIQGFSSSDQILSHDTSAPSPAACEERHGAFWSYQLAPNPPGDPKDGPMGNSGGNHVAVFWLCLLCRLGFSKPQAFMDHTQSHGVKLTPAQYQGLSGSPAVLQEGDEGCKALISFLEPKLPARPSSDIPLDNSSTVNMEANVAQTEDGPPEAEVQALILLDEEVMALSPPSPPTATWDPSPTQAKESPVAAGEAGPDWFPEGQEEDGGLCPPLNQSSPTSKEGGTLPAPVGSPEDPSDPPQPYRLADDYTPAPAAFQGLSLSSHMSLLHSRNSCKTLKCPKCNWHYKYQQTLDVHMREKHPESNSHCSYCSAGGAHPRLARGESYNCGYKPYRCDVCNYSTTTKGNLSIHMQSDKHLANLQGFQAGPGGQGSPPEASLPPSAGDKEPKTKSSWQCKVCSYETNISRNLRIHMTSEKHMQNVLMLHQGLPLGLPPGLMGPGPPPPPGATPTSPPELFQYFGPQALGQPQTPLAGPGLRPDKPLEAQLLLNGFHHVGAPARKFPTSAPGSLSPDAHLPPSQLLGSSSDSLPTSPPPDDSLSLKVFRCLVCQAFSTDSLELLLYHCSIGRSLPEAEWKEVAGDTHRCKLCCYGTQLKANFQLHLKTDKHAQKYQLAAHLREGGGAMGTPSPASLGDGAPYGSVSPLHLRCNICDFESNSKEKMQLHARGAAHEENSQIYKFLLDMEGAEAGAELGLYHCLLCAWETPSRLAVLQHLRTPAHRDAQAQRRLQLLQNGPTTEEGLAALQSILSFSHGQLRTPGKAPVTPLAEPPTPEKDAQNKTEQLASEETENKTGPSRDSANQTTVYCCPYCSFLSPESSQVRAHTLSQHAVQPKYRCPLCQEQLVGRPALHFHLSHLHNVVPECVEKLLLVATTVEMTFTTKVLSAPTLSPLDNGQEPPTHGPEPTPSRDQAAEGPNLTPEASPDPLPEPPLASVEVPDKPSGSPGQPPSPAPSPVPEPDAQAEDVAPPPTMAEEEEGTTGELRSAEPAPADSRHPLTYRKTTNFALDKFLDPARPYKCTVCKESFTQKNILLVHYNSVSHLHKMKKAAIDPSAPARGEAGAPPTTTAATDKPFKCTVCRVSYNQSSTLEIHMRSVLHQTRSRGTKTDSKIEGPERSQEEPKEGETEGEVGTEKKGPDTSGFISGLPFLSPPPPPLDLHRFPAPLFTPPVLPPFPLVPESLLKLQQQQLLLPFYLHDLKVGPKLTLAGPAPVLSLPAATPPPPPQPPKAELAEREWERPPMAKEGNEAGPSSPPDPLPNEAARTAAKALLENFGFELVIQYNEGKQAVPPPPTPPPPEALGGGDKLACGACGKLFSNMLILKTHEEHVHRRFLPFEALSRYAAQFRKSYDSLYPPLAEPPKPPDGSLDSPVPHLGPPFLVPEPEAGGTRAPEERSRAGGHWPIEEEESSRGNLPPLVPAGRRFSRTKFTEFQTQALQSFFETSAYPKDGEVERLASLLGLASRVVVVWFQNARQKARKNACEGGSMPTGGGTGGASGCRRCHATFSCVFELVRHLKKCYDDQTLEEEEEEAERGEEEEEVEEEEVEEEQGLEPPAGPEGPLPEPPDGEELSQAEATKAGGKEPEEKATPSPSPAHTCDQCAISFSSQDLLTSHRRLHFLPSLQPSAPPQLLDLPLLVFGERNPLVAATSPMPGPPLKRKHEDGSLSPTGSEAGGGGEGEPPRDKRLRTTILPEQLEILYRWYMQDSNPTRKMLDCISEEVGLKKRVVQVWFQNTRARERKGQFRSTPGGVPSPAVKPPATATPASLPKFNLLLGKVDDGTGREAPKREAPAFPYPTATLASGPQPFLPPGKEATTPTPEPPLPLLPPPPPSEEEGPEEPPKASPESEACSLSAGDLSDSSASSLAEPESPGAGGTSGGPGGGTGVPDGMGQRRYRTQMSSLQLKIMKACYEAYRTPTMQECEVLGEEIGLPKRVIQVWFQNARAKEKKAKLQGTAAGSTGGSSEGLLAAQRTDCPYCDVKYDFYVSCRGHLFSRQHLAKLKEAVRAQLKSESKCYDLAPAPEAPPALKAPPATTPASMPLGAAPTLPRLAPVLLSGPALAQPPLGNLAPFNSGPAASSGLLGLATSVLPTTTVVQTAGPGRPLPQRPMPDQTNTSTAGTTDPVPGPPTEPLGDKVSSERKPVAGPTSSSNDALKNLKALKTTVPALLGGQFLPFPLPPAGGTAPPAVFGPQLQGAYFQQLYGMKKGLFPMNPMIPQTLIGLLPNALLQPPPQPPEPTATAPPKPPELPAPGEGEAGEVDELLTGSTGISTVDVTHRYLCRQCKMAFDGEAPATAHQRSFCFFGRGSGGSMPPPLRVPICTYHCLACEVLLSGREALASHLRSSAHRRKAAPPQGGPPISITNAATAASAAVAFAKEEARLPHTDSNPKTTTTSTLLAL

SEQ ID NO: 15916 - protein, 3703 aa, Homo Sapiens
MEGCDSPVVSGKDNGCGIPQHQQWTELNSTHLPDKPSSMEQSTGESHGPLDSLRAPFNERLAESTASAGPPSEPASKEVTCNECSASFASLQTYMEHHCPSARPPPPLREESASDTGEEGDEESDVENLAGEIVYQPDGSAYIVESLSQLTQGGGACGSGSGSGPLPSLFLNSLPGAGGKQGDPSCAAPVYPQIINTFHIASSFGKWFEGPDQAFPNTSALAGLSPVLHSFRVFDVRHKSNKDYLNSDGSAKSSCVSKDVPNNVDLSKFDGFVLYGKRKPILMCFLCKLSFGYVRSFVTHAVHDHRMTLSEDERKILSNKNISAIIQGIGKDKEPLVSFLEPKNKNFQHPLVSTANLIGPGHSFYGKFSGIRMEGEEALPAGSAAGPEQPQAGLLTPSTLLNLGGLTSSVLKTPITSVPLGPLASSPTKSSEGKDSGAAEGEKQEVGDGDCFSEKVEPAEEEAEEEEEEEEAEEEEEEEEEEEEEEEDEGCKGLFPSELDEELEDRPHEEPGAAAGSSSKKDLALSNQSISNSPLMPNVLQTLSRGTASTSSNSASSFVVFDGANRRNRLSFNSEGVRANVAEGGRRLDFADESANKDNATAPEPNESTEGDDGGFVPHHQHAGSLCELGVGECPSGSGVECPKCDTVLGSSRSLGGHMTMMHSRNSCKTLKCPKCNWHYKYQQTLEAHMKEKHPEPGGSCVYCKSGQPHPRLARGESYTCGYKPFRCEVCNYSTTTKGNLSIHMQSDKHLNNMQNLQNGGGEQVFSHTAGAAAAAVAAAAAAANISSSCGAPSPTKPKTKPTWRCEVCDYETNVARNLRIHMTSEKHMHNMMLLQQNMTQIQHNRHLGLGSLPSPAEAELYQYYLAQNMNLPNLKMDSAASDAQFMMSGFQLDPAGPMAAMTPALVGGEIPLDMRLGGGQLVSEELMNLGESFIQTNDPSLKLFQCAVCNKFTTDNLDMLGLHMNVERSLSEDEWKAVMGDSYQCKLCRYNTQLKANFQLHCKTDKHVQKYQLVAHIKEGGKANEWRLKCVAIGNPVHLKCNACDYYTNSLEKLRLHTVNSRHEASLKLYKHLQQHESGVEGESCYYHCVLCNYSTKAKLNLIQHVRSMKHQRSESLRKLQRLQKGLPEEDEDLGQIFTIRRCPSTDPEEAIEDVEGPSETAADPEELAKDQEGGASSSQAEKELTDSPATSKRISFPGSSESPLSSKRPKTAEEIKPEQMYQCPYCKYSNADVNRLRVHAMTQHSVQPMLRCPLCQDMLNNKIHLQLHLTHLHSVAPDCVEKLIMTVTTPEMVMPSSMFLPAAVPDRDGNSNLEEAGKQPETSEDLGKNILPSASTEQSGDLKPSPADPGSVREDSGFICWKKGCNQVFKTSAALQTHFNEVHAKRPQLPVSDRHVYKYRCNQCSLAFKTIEKLQLHSQYHVIRAATMCCLCQRSFRTFQALKKHLETSHLELSEADIQQLYGGLLANGDLLAMGDPTLAEDHTIIVEEDKEEESDLEDKQSPTGSDSGSVQEDSGSEPKRALPFRKGPNFTMEKFLDPSRPYKCTVCKESFTQKNILLVHYNSVSHLHKLKRALQESATGQPEPTSSPDNKPFKCNTCNVAYSQSSTLEIHMRSVLHQTKARAAKLEAASGSSNGTGNSSSISLSSSTPSPVSTSGSNTFTTSNPSSAGIAPSSNLLSQVPTESVGMPPLGNPIGANIASPSEPKEANRKKLADMIASRQQQQQQQQQQQQQQQQQQQAQTLAQAQAQVQAHLQQELQQQAALIQSQLFNPTLLPHFPMTTETLLQLQQQQHLLFPFYIPSAEFQLNPEVSLPVTSGALTLTGTGPGLLEDLKAQVQVPQQSHQQILPQQQQNQLSIAQSHSALLQPSQHPEKKNKLVIKEKEKESQRERDSAEGGEGNTGPKETLPDALKAKEKKELAPGGGSEPSMLPPRIASDARGNATKALLENFGFELVIQYNENKQKVQKKNGKTDQGENLEKLECDSCGKLFSNILILKSHQEHVHQNYFPFKQLERFAKQYRDHYDKLYPLRPQTPEPPPPPPPPPPPPLPAAPPQPASTPAIPASAPPITSPTIAPAQPSVPLTQLSMPMELPIFSPLMMQTMPLQTLPAQLPPQLGPVEPLPADLAQLYQHQLNPTLLQQQNKRPRTRITDDQLRVLRQYFDINNSPSEEQIKEMADKSGLPQKVIKHWFRNTLFKERQRNKDSPYNFSNPPITSLEELKIDSRPPSPEPPKQEYWGSKRSSRTRFTDYQLRVLQDFFDANAYPKDDEFEQLSNLLNLPTRVIVVWFQNARQKARKNYENQGEGKDGERRELTNDRYIRTSNLNYQCKKCSLVFQRIFDLIKHQKKLCYKDEDEEGQDDSQNEDSMDAMEILTPTSSSCSTPMPSQAYSAPAPSANNTASSAFLQLTAEAEELATFNSKTEAGDEKPKLAEAPSAQPNQTQEKQGQPKPELQQQEQPEQKTNTPQQKLPQLVSLPSLPQPPPQAPPPQCPLPQSSPSPSQLSHLPLKPLHTSTPQQLANLPPQLIPYQCDQCKLAFPSFEHWQEHQQLHFLSAQNQFIHPQFLDRSLDMPFMLFDPSNPLLASQLLSGAIPQIPASSATSPSTPTSTMNTLKRKLEEKASASPGENDSGTGGEEPQRDKRLRTTITPEQLEILYQKYLLDSNPTRKMLDHIAHEVGLKKRVVQVWFQNTRARERKGQFRAVGPAQAHRRCPFCRALFKAKTALEAHIRSRHWHEAKRAGYNLTLSAMLLDCDGGLQMKGDIFDGTSFSHLPPSSSDGQGVPLSPVSKTMELSPRTLLSPSSIKVEGIEDFESPSMSSVNLNFDQTKLDNDDCSSVNTAITDTTTGDEGNADNDSATGIATETKSSSAPNEGLTKAAMMAMSEYEDRLSSGLVSPAPSFYSKEYDNEGTVDYSETSSLADPCSPSPGASGSAGKSGDSGDRPGQKRFRTQMTNLQLKVLKSCFNDYRTPTMLECEVLGNDIGLPKRVVQVWFQNARAKEKKSKLSMAKHFGINQTSYEGPKTECTLCGIKYSARLSVRDHIFSQQHISKVKDTIGSQLDKEKEYFDPATVRQLMAQQELDRIKKANEVLGLAAQQQGMFDNTPLQALNLPTAYPALQGIPPVLLPGLNSPSLPGFTPSNTALTSPKPNLMGLPSTTVPSPGLPTSGLPNKPSSASLSSPTPAQATMAMGPQQPPQQQQQQQQPQVQQPPPPPAAQPPPTPQLPLQQQQQRKDKDSEKVKEKEKAHKGKGEPLPVPKKEKGEAPTATAATISAPLPTMEYAVDPAQLQALQAALTSDPTALLTSQFLPYFVPGFSPYYAPQIPGALQSGYLQPMYGMEGLFPYSPALSQALMGLSPGSLLQQYQQYQQSLQEAIQQQQQRQLQQQQQQKVQQQQPKASQTPVPPGAPSPDKDPAKESPKPEEQKNTPREVSPLLPKLPEEPEAESKSADSLYDPFIVPKVQYKLVCRKCQAGFSDEEAARSHLKSLCFFGQSVVNLQEMVLHVPTGGGGGGSGGGGGGGGGGGGGGSYHCLACESALCGEEALSQHLESALHKHRTITRAARNAKEHPSLLPHSACFPDPSTASTSQSAAHSNDSPPPPSAAAPSSASPHASRKSWPQVVSRASAAKPPSFPPLSSSSTVTSSSCSTSGVQPSMPTDDYSEESDTDLSQKSDGPASPVEGPKDPSCPKDSGLTSVGTDTFRL

SEQ ID NO: 15917 - protein, 3567 aa, Homo Sapiens
METCDSPPISRQENGQSTSKLCGTTQLDNEVPEKVAGMEPDRENSSTDDNLKTDERKSEALLGFSVENAAATQVTSAKEIPCNECATSFPSLQKYMEHHCPNARLPVLKDDNESEISELEDSDVENLTGEIVYQPDGSAYIIEDSKESGQNAQTGANSKLFSTAMFLDSLASAGEKSDQSASAPMSFYPQIINTFHIASSLGKPFTADQAFPNTSALAGVGPVLHSFRVYDLRHKREKDYLTSDGSAKNSCVSKDVPNNVDLSKFDGCVSDGKRKPVLMCFLCKLSFGYIRSFVTHAVHDHRMTLNDEEQKLLSNKCVSAIIQGIGKDKEPLISFLEPKKSTSVYPHFSTTNLIGPDPTFRGLWSAFHVENGDSLPAGFAFLKGSASTSSSAEQPLGITQMPKAEVNLGGLSSLVVNTPITSVSLSHSSSESSKMSESKDQENNCERPKESNVLHPNGECPVKSEPTEPGDEDEEDAYSNELDDEEVLGELTDSIGNKDFPLLNQSISPLSSSVLKFIEKGTSSSSATVSDDTEKKKQTAAVRASGSVASNYGISGKDFADASASKDSATAAHPSEIARGDEDSSATPHQHGFTPSTPGTPGPGGDGSPGSGIECPKCDTVLGSSRSLGGHMTMMHSRNSCKTLKCPKCNWHYKYQQTLEAHMKEKHPEPGGSCVYCKTGQPHPRLARGESYTCGYKPFRCEVCNYSTTTKGNLSIHMQSDKHLNNVQNLQNGNGEQVFGHSAPAPNTSLSGCGTPSPSKPKQKPTWRCEVCDYETNVARNLRIHMTSEKHMHNMMLLQQNMKQIQHNLHLGLAPAEAELYQYYLAQNIGLTGMKLENPADPQLMINPFQLDPATAAALAPGLGELSPYISDPALKLFQCAVCNKFTSDSLEALSVHVSSERSLPEEEWRAVIGDIYQCKLCNYNTQLKANFQLHCKTDKHMQKYQLVAHIKEGGKSNEWRLKCIAIGNPVHLKCNACDYYTNSVDKLRLHTTNHRHEAALKLYKHLQKQEGAVNPESCYYYCAVCDYTTKVKLNLVQHVRSVKHQQTEGLRKLQLHQQGLAPEEDNLSEIFFVKDCPPNELETASLGARTCDDDLTEQHEEAEGAIKPTAVAEDDEKDTSERDNSEGKNSNKDSVSVAGGTQPLLLAKEEDVATKRSKPTEDNKFCHEQFYQCPYCNYNSRDQSRIQMHVLSQHSVQPVICCPLCQDVLSNKMHLQLHLTHLHSVSPDCVEKLLMTVPVPDVMMPNSMLLPAAASEKSERDTPAAVTAEGSGKYSGESPMDDKSMAGLEDSKANVEVKNEEQKPTKEPLEVSEWNKNSSKDVKIPDTLQDQLNEQQKRQPLSVSDRHVYKYRCNHCSLAFKTMQKLQIHSQYHAIRAATMCNLCQRSFRTFQALKKHLEAGHPELSEAELQQLYASLPVNGELWAESETMSQDDHGLEQEMEREYEVDHEGKASPVGSDSSSIPDDMGSEPKRTLPFRKGPNFTMEKFLDPSRPYKCTVCKESFTQKNILLVHYNSVSHLHKLKKVLQEASSPVPQETNSNTDNKPYKCSICNVAYSQSSTLEIHMRSVLHQTKARAAKLEPSGHVAGGHSIAANVNSPGQGMLDSMSLAAVNSKDTHLDAKELNKKQTPDLISAQPAHHPPQSPAQIQMQLQHELQQQAAFFQPQFLNPAFLPHFPMTPEALLQFQQPQFLFPFYIPGTEFSLGPDLGLPGSATFGMPGMTGMAGSLLEDLKQQIQTQHHVGQTQLQILQQQAQQYQATQPQLQPQKQQQQPPPPQQQQQQQASKLLKQEQSNIVSADCQIMKDVPSYKEAEDISEKPEKPKQEFISEGEGLKEGKDTKKQKSLEPSIPPPRIASGARGNAAKALLENFGFELVIQYNENRQKVQKKGKSGEGENTDKLECGTCGKLFSNVLILKSHQEHVHGQFFPYAALEKFARQYREAYDKLYPISPSSPETPPPPPPPPPLPPAPPQPSSMGPVKIPNTVSTPLQAPPPTPPPPPPPPPPPPPPPPPPPPSAPPQVQLPVSLDLPLFPSIMMQPVQHPALPPQLALQLPQMDALSADLTQLCQQQLGLDPNFLRHSQFKRPRTRITDDQLKILRAYFDINNSPSEEQIQEMAEKSGLSQKVIKHWFRNTLFKERQRNKDSPYNFSNPPITVLEDIRIDPQPTSLEHYKSDASFSKRSSRTRFTDYQLRVLQDFFDTNAYPKDDEIEQLSTVLNLPTRVIVVWFQNARQKARKSYENQAETKDNEKRELTNERYIRTSNMQYQCKKCNVVFPRIFDLITHQKKQCYKDEDDDAQDESQTEDSMDATDQVVYKHCTVSGQTDAAKNAAAPAASSGSGTSTPLIPSPKPEPEKTSPKPEYPAEKPKQSDPSPPSQGTKPALPLASTSSDPPQASTAQPQPQPQPPKQPQLIGRPPSASQTPVPSSPLQISMTSLQNSLPPQLLQYQCDQCTVAFPTLELWQEHQHMHFLAAQNQFLHSPFLERPMDMPYMIFDPNNPLMTGQLLGSSLTQMPPQASSSHTTAPTTVAASLKRKLDDKEDNNCSEKEGGNSGEDQHRDKRLRTTITPEQLEILYEKYLLDSNPTRKMLDHIAREVGLKKRVVQVWFQNTRARERKGQFRAVGPAQSHKRCPFCRALFKAKSALESHIRSRHWNEGKQAGYSLPPSPLISTEDGGESPQKYIYFDYPSLPLTKIDLSSENELASTVSTPVSKTAELSPKNLLSPSSFKAECSEDVENLNAPPAEAGYDQNKTDFDETSSINTAISDATTGDEGNTEMESTTGSSGDVKPALSPKEPKTLDTLPKPATTPTTEVCDDKFLFSLTSPSIHFNDKDGDHDQSFYITDDPDDNADRSETSSIADPSSPNPFGSSNPFKSKSNDRPGHKRFRTQMSNLQLKVLKACFSDYRTPTMQECEMLGNEIGLPKRVVQVWFQNARAKEKKFKINIGKPFMINQGGTEGTKPECTLCGVKYSARLSIRDHIFSKQHISKVRETVGSQLDREKDYLAPTTVRQLMAQQELDRIKKASDVLGLTVQQPGMMDSSSLHGISLPTAYPGLPGLPPVLLPGMNGPSSLPGFPQNSNISAGMLGFPTSATSSPALSLSSAPTKPLLQTPPPPPPPPPPPPSSSLSGQQTEQQNKESEKKQTKPNKVKKIKEEELEATKPEKHPKKEEKISSALSVLGKVVGETHVDPIQLQALQNAIAGDPASFIGGQFLPYFIPGFASYFTPQLPGTVQGGYFPPVCGMESLFPYGPTMPQTLAGLSPGALLQQYQQYQQNLQESLQKQQKQQQEQQQKPVQAKTSKVESDQPQNSNDASETKEDKSTATESTKEEPQLESKSADFSDTYVVPFVKYEFICRKCQMMFTDEDAAVNHQKSFCYFGQPLIDPQETVLRVPVSKYQCLACDVAISGNEALSQHLQSSLHKEKTIKQAMRNAKEHVRLLPHSVCSPNPNTTSTSQSAASSNNTYPHLSCFSMKSWPNILFQASARRAASPPSSPPSLSLPSTVTSSLCSTSGVQTSLPTESCSDESDSELSQKLEDLDNSLEVKAKPASGLDGNFNSIRMDMFSV

SEQ ID NO: 15918 - protein, 407 aa, Homo Sapiens
MNKSQGSVSFTDVTVDFTQEEWEQLDPSQRILYMDVMLENYSNLLSVEVWKADDQMERDHRNPDEQARQFLILKNQTPIEERGDLFGKALNLNTDFVSLRQVPYKYDLYEKTLKYNSDLLNSNRSYAGKQTDECNEFGKALLYLKQEKTHSGVEYSEYNKSGKALSHKAAIFKHQKIKNLVQPFICTYCDKAFSFKSLLISHKRIHTGEKPYECNVCKKTFSHKANLIKHQRIHTGEKPFECPECGKAFTHQSNLIVHQRAHMEKKPYECSECGKTFAQKFELTTHQRIHTGERPYECNECAKTFFKKSNLIIHQKIHTGEKRYECSECGKSFIQNSQLIIHMRTHTGEKPYECTECGKTFSQRSTLRLHLRIHTGEKPYECSECGKAFSRKSRLSVHQRVHIGEKP

SEQ ID NO: 15919 - protein, 533 aa, Homo Sapiens
MAHGSVTFRDVAIDFSQEEWEFLDPAQRDLYRDVMWENYSNFISLGPSISKPDVITLLDEERKEPGMVVREGTRRYCPDLESRYRTNTLSPEKDIYEIYSFQWDIMERIKSYSLQGSIFRNDWECKSKIEGEKEQQEGYFGQVKITSEKMTTYKRHNFLTEYQIVHNGEKVYECKECRKTFIRRSTLSQHLRIHTGEKPYKCKECGQAFRQRAHLIRHHKLHTGEKPYECKECGKAFTVLQELTQHQRLHTGEKPYECKECGKAFRVHQQLARHQRIHTGEKPYECKDCGKTFRQCTHLTRHQRLHTAEKLYECKECGKAFVCGPDLRVHQKIHFGEKPYECKECGKAFRICQQLTVHQSIHTGEKPYECKECGKTFRLRQQLVRHQRIHTREKPYECMECWKTFSSYSQLISHQSIHIGERPYECEECGKAFRLLSQLTQHQSIHTGEKPYECKECRKPFRLLSQLTQHQSIHTGEKPYECKECGKAFRLYSFLTQHQRIHTGEKPYKCKECKKAFRQHSHLTQHQKIHNGI

SEQ ID NO: 15920 - protein, 461 aa, Homo Sapiens
MEREGIWHSTLGETWEPNNWLEGQQDSHLSQVGVTHKETFTEMRVCGGNEFERCSSQDSILDTQQSIPMVKRPHNCNSHGEDATQNSELIKTQRMFVGKKIYECNQCSKTFSQSSSLLKHQRIHTGEKPYKCNVCGKHFIERSSLTVHQRIHTGEKPYKCNECGKAFSQSMNLTVHQRTHTGEKPYQCKECGKAFHKNSSLIQHERIHTGEKPYKCNECGKAFTQSMNLTVHQRTHTGEKPYECNECGKAFSQSMHLIVHQRSHTGEKPYECSQCGKAFSKSSTLTLHQRNHTGEKPYKCNKCGKSFSQSTYLIEHQRLHSGVKPFECNECGKAFSKNSSLTQHRRIHTGEKPYECMVCGKHFTGRSSLTVHQVIHTGEKPYECNECGKAFSQSAYLIEHQRIHTGEKPYECDQCGKAFIKNSSLTVHQRTHTGEKPYQCNECGKAFSRSTNLTRHQRTHT

SEQ ID NO: 15921 - protein, 868 aa, Homo Sapiens
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKNGIWENNSDLGSAGHCVAKPDLVSLLEQEKEPWMVKRELTGSLFSGQRSVHETQELFPKQDSYAEGVTDRTSNTKLDCSSFRENWDSDYVFGRKLAVGQETQFRQEPITHNKTLSKERERTYNKSGRWFYLDDSEEKVHNRDSIKNFQKSSVVIKQTGIYAGKKLFKCNECKKTFTQSSSLTVHQRIHTGEKPYKCNECGKAFSDGSSFARHQRCHTGKKPYECIECGKAFIQNTSLIRHWRYYHTGEKPFDCIDCGKAFSDHIGLNQHRRIHTGEKPYKCDVCHKSFRYGSSLTVHQRIHTGEKPYECDVCRKAFSHHASLTQHQRVHSGEKPFKCKECGKAFRQNIHLASHLRIHTGEKPFECAECGKSFSISSQLATHQRIHTGEKPYECKVCSKAFTQKAHLAQHQKTHTGEKPYECKECGKAFSQTTHLIQHQRVHTGEKPYKCMECGKAFGDNSSCTQHQRLHTGQRPYECIECGKAFKTKSSLICHRRSHTGEKPYECSVCGKAFSHRQSLSVHQRIHSGKKPYECKECRKTFIQIGHLNQHKRVHTGERSYNYKKSRKVFRQTAHLAHHQRIHTGESSTCPSLPSTSNPVDLFPKFLWNPSSLPSP

SEQ ID NO: 15922 - protein, 502 aa, Homo Sapiens
MGTENKEVIPKEEISEESEPHGSLLEKFPKVVYQGHEFGAGCEEDMLEGHSRESMEEVIEQMSPQERDFPSGLMIFKKSPSSEKDRENNESERGCSPSPNLVTHQGDTTEGVSAFATSGQNFLEILESNKTQRSSVGEKPHTCKECGKAFNQNSHLIQHMRVHSGEKPFECKECGKTFGTNSSLRRHLRIHAGEKPFACNECGKAFIQSSHLIHHHRIHTGERPYKCEECGKAFSQNSALILHQRIHTGEKPYECNECGKTFRVSSQLIQHQRIHTEERYHECNECGKAFKHSSGLIRHQKIHTGEKPYLCNECGKGFGQSSELIRHQRIHTGDKPYECNECGKTFGQNSEIIRHIRIHTGEKPYVCKECGKAFRGNSELLRHERIHTGEKPYECFECGKAFRRTSHLIVHQRIHTGEKPHQCNECARTFWDNSELLLHQKIHIGEKPYECSECEKTFSQHSQLIIHQRIHTGEKPYECQECQKTFSRSSHLLRHQSVHCME

SEQ ID NO: 15923 - protein, 519 aa, Homo Sapiens
MARDLVMFRDVAVDFSQEEWECLNSYQRNLYRDVILENYSNLVSLAGCSISKPDVITLLEQGKEPWMVVRDEKRRWTLDLESRYDTKKLFQGKDIYEMNLSQWKVMERIKSCGLEEQESPHEVCFRQVTKTTSEKMPTYRKLTSLPLYQKSHNREKPYECGECGKAFRVRQQLTFHQRIHTGEKPYECKECGKAFRQCAHLSRHQRIHTSDKLYECKKCGKIFTCGSDLRVHQRIHIGEKPYECKECGKAFRVRGQLNLHQRIHTGEKPYECKECGKAFRQYAHLTRHQRLNIAEKCYECKECGQAFLCSTGLRLHHKLHTGEKPYECKECGKAFRVRQQLTLHQRIHTGEKPYDCKECGKTFSRGYHLTLHQRIHTGEKPYECKECQKFFRRYSELISHQGIHIGEKPYECKECGKAFRLFSQLTQHQSIHFGEKPFKCKECEKTFRLLSQLTQHQSIHTGEKPYDCKECGKAFRLHSSLIQHQRIHSGEKPYKCKECKKAFRQHSHLTYHQRIHNVT

SEQ ID NO: 15924 - protein, 338 aa, Homo Sapiens
MTTTLVSATIFDLSEVLCKGNKMLNYSAPSAGGCLLDRKAVGTPAGGGFPRRHSVTLPSSKFHQNQLLSSLKGEPAPALSSRDSRFRDRSFSEGGERLLPTQKQPGGGQVNSSRYKTELCRPFEENGACKYGDKCQFAHGIHELRSLTRHPKYKTELCRTFHTIGFCPYGPRCHFIHNAEERRALAGARDLSADRPRLQHSFSFAGFPSAAATAAATGLLDSPTSITPPPILSADDLLGSPTLPDGTNNPFAFSSQELASLFAPSMGLPGGGSPTTFLFRPMSESPHMFDSPPSPQDSLSDQEGYLSSSSSSHSGSDSPTLDNSRRLPIFSRLSISDD

SEQ ID NO: 15925 - protein, 494 aa, Homo Sapiens
MSTTLLSAFYDVDFLCKTEKSLANLNLNNMLDKKAVGTPVAAAPSSGFAPGFLRRHSASNLHALAHPAPSPGSCSPKFPGAANGSSCGSAAAGGPTSYGTLKEPSGGGGTALLNKENKFRDRSFSENGDRSQHLLHLQQQQKGGGGSQINSTRYKTELCRPFEESGTCKYGEKCQFAHGFHELRSLTRHPKYKTELCRTFHTIGFCPYGPRCHFIHNADERRPAPSGGASGDLRAFGTRDALHLGFPREPRPKLHHSLSFSGFPSGHHQPPGGLESPLLLDSPTSRTPPPPSCSSASSCSSSASSCSSASAASTPSGAPTCCASAAAAAAAALLYGTGGAEDLLAPGAPCAACSSASCANNAFAFGPELSSLITPLAIQTHNFAAVAAAAYYRSQQQQQQQGLAPPAQPPAPPSATLPAGAAAPPSPPFSFQLPRRLSDSPVFDAPPSPPDSLSDRDSYLSGSLSSGSLSGSESPSLDPGRRLPIFSRLSISDD

SEQ ID NO: 15926 - protein, 630 aa, Homo Sapiens
MSVSSGVQILTKPETVDRRRSAETTKEAGRPLEMAVSEPEASAAEWKQLDPAQSNLYNDVMLENYCNQASMGCQAPKPDMISKLEKGEAPWLGKGKRPSQGCPSKIARPKQKETDGKVQKDDDQLENIQKSQNKLLREVAVKKKTQAKKNGSDCGSLGKKNNLHKKHVPSKKRLLKFESCGKILKQNLDLPDHSRNCVKRKSDAAKEHKKSFNHSLSDTRKGKKQTGKKHEKLSSHSSSDKCNKTGKKHDKLCCHSSSHIKQDKIQTGEKHEKSPSLSSSTKHEKPQACVKPYECNQCGKVLSHKQGLIDHQRVHTGEKPYECNECGIAFSQKSHLVVHQRTHTGEKPYECIQCGKAHGHKHALTDHLRIHTGEKPYECAECGKTFRHSSNLIQHVRSHTGEKPYECKECGKSFRYNSSLTEHVRTHTGEIPYECNECGKAFKYSSSLTKHMRIHTGEKPFECNECGKAFSKKSHLIIHQRTHTKEKPYKCNECGKAFGHSSSLTYHMRTHTGESPFECNQCGKGFKQIEGLTQHQRVHTGEKPYECNECGKAFSQKSHLIVHQRTHTGEKPYECNECEKAFNAKSQLVIHQRSHTGEKPYECNECGKTFKQNASLTKHVKTHSEDKSHE

SEQ ID NO: 15927 - protein, 198 aa, Homo Sapiens
MEKPAGRKKKTPTPREEADVQKSALREEKVSGDRKPPERPTVPRKPRTEPCLSPEDEEHVFDAFDASFKDDFEGVPVFIPFQRKKPYECSECGRIFKHKTDHIRHQRVHTGEKPFKCAQCGKAFRHSSDVTKHQRTHTGEKPFKCGECGKAFNCGSNLLKHQKTHTGEKPYECTHCGKAFAYSSCLIRHQKRHPRKKP

SEQ ID NO: 15928 - protein, 310 aa, Homo Sapiens
MSQQLKKRAKTRHQKGLGGRAPSGAKPRQGKSSQDLQAEIEPVSAVWALCDGYVCYEPGPQALGGDDFSDCYIECVIRGEFSQPILEEDSLFESLEYLKKGSEQQLSQKVFEASSLECSLEYMKKGVKKELPQKIVGENSLEYSEYMTGKKLPPGGIPGIDLSDPKQLAEFARKKPPINKEYDSLSAIACPQSGCTRKLRNRAALRKHLLIHGPRDHVCAECGKAFVESSKLKRHFLVHTGEKPFRCTFEGCGKRFSLDFNLRTHVRIHTGEKRFVCPFQGCNRRFIQSNNLKAHILTHANTNKNEQEGK

SEQ ID NO: 15929 - protein, 452 aa, Homo Sapiens
MAAGEPRSLLFFQKPVTFEDVAVNFTQEEWDCLDASQRVLYQDVMSETFKNLTSVARIFLHKPELITKLEQEEEQWRETRVLQASQAGPPFFCYTCGKCFSRRSYLYSHQFVHNPKLTNSCSQCGKLFRSPKSLSYHRRMHLGERPFCCTLCDKTYCDASGLSRHRRVHLGYRPHSCSVCGKSFRDQSELKRHQKIHQNQEPVDGNQECTLRIPGTQAEFQTPIARSQRSIQGLLDVNHAPVARSQEPIFRTEGPMAQNQASVLKNQAPVTRTQAPITGTLCQDARSNSHPVKPSRLNVFCCPHCSLTFSKKSYLSRHQKAHLTEPPNYCFHCSKSFSSFSRLVRHQQTHWKQKSYLCPICDLSFGEKEGLMDHWRGYKGKDLCQSSHHKCRVILGQWLGFSHDVPTMAGEEWKHGGDQSPPRIHTPRRRGLREKACKGDKTKEAVSILKHK

SEQ ID NO: 15930 - protein, 900 aa, Homo Sapiens
MSHLKTSTEDEEPTEEYENVGNAASKWPKVEDPMPESKVGDTCVWDSKVENQQKKPVENRMKEDKSSIREAISKAKSTANIKTEQEGEASEKSLHLSPQHITHQTMPIGQRGSEQGKRVENINGTSYPSLQQKTNAVKKLHKCDECGKSFKYNSRLVQHKIMHTGEKRYECDDCGGTFRSSSSLRVHKRIHTGEKPYKCEECGKAYMSYSSLINHKSTHSGEKNCKCDECGKSFNYSSVLDQHKRIHTGEKPYECGECGKAFRNSSGLRVHKRIHTGEKPYECDICGKTFSNSSGLRVHKRIHTGEKPYECDECGKAFITCRTLLNHKSIHFGDKPYKCDECEKSFNYSSLLIQHKVIHTGEKPYECDECGKAFRNSSGLIVHKRIHTGEKPYKCDVCGKAFSYSSGLAVHKSIHPGKKAHECKECGKSFSYNSLLLQHRTIHTGERPYVCDVCGKTFRNNAGLKVHRRLHTGEKPYKCDVCGKAYISRSSLKNHKGIHLGEKPYKCSYCEKSFNYSSALEQHKRIHTREKPFGCDECGKAFRNNSGLKVHKRIHTGERPYKCEECGKAYISLSSLINHKSVHPGEKPFKCDECEKAFITYRTLTNHKKVHLGEKPYKCDVCEKSFNYTSLLSQHRRVHTREKPYECDRCEKVFRNNSSLKVHKRIHTGERPYECDVCGKAYISHSSLINHKSTHPGRTPHTCDECGKAFFSSRTLISHKRVHLGEKPFKCVECGKSFSYSSLLSQHKRIHTGEKPYVCDRCGKAFRNSSGLTVHKRIHTGEKPYECDECGKAYISHSSLINHKSVHQGKQPYNCECGKSFNYRSVLDQHKRIHTGKKPYRCNECGKAFNIRSNLTKHKRTHTGEESLNVIYVGSYSGTSQKRTYEGGNALDGGRMRMPL

SEQ ID NO: 15931 - protein, 681 aa, Homo Sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTGDAPFQCWLCSAKFKISSDLKRHMRVHSGEKPFKCEFCNVRCTMKGNLKSHIRIKHSGNNFKCPHCDFLGDSKATLRKHSRVHQSEHPEKCSECSYSCSSKAALRIHERIHCTDRPFKCNYCSFDTKQPSNLSKHMKKFHGDMVKTEALERKDTGRQSSRQVAKLDAKKSFHCDICDASFMREDSLRSHKRQHSEYSESKNSDVTVLQFQIDPSKQPATPLTVGHLQVPLQPSQVPQFSEGRVKIIVGHQVPQANTIVQAAAAAVNIVPPALVAQNPEELPGNSRLQILRQVSLIAPPQSSRCPSEAGAMTQPAVLLTTHEQTDGATLHQTLIPTASGGPQEGSGNQTFITSSGITCTDFEGLNALIQEGTAEVTVVSDGGQNIAVATTAPPVFSSSSQQELPKQTYSIIQGAAHPALLCPADSIPD

SEQ ID NO: 15932 - protein, 645 aa, Homo Sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTASELDDDVPKANCLSTESTDTPKAPVITLPSEAREQMATLGERTFNCCYPGCHFKTVHGMKDLDRHLRIHTGDKPHKCEFCDKCFSRKDNLTMHMRCHTSVKPHKCHLCDYAAVDSSSLKKHLRIHSDERPYKCQLCPYASRNSSQLTVHLRSHTGDTPFQCWLCSAKFKISSDLKRHMIVHSGEKPFKCEFCDVRCTMKANLKSHIRIKHTFKCLHCAFQGRDRADLLEHSRLHQADHPEKCPECSYSCSSAAALRVHSRVHCKDRPFKCDFCSFDTKRPSSLAKHVDKVHRDEAKTENRAPLGKEGLREGSSQHVAKIVTQRAFRCETCGASFVRDDSLRCHKKQHSDQSENKNSDLVTFPPESGASGQLSTLVSVGQLEAPLEPSQDL

SEQ ID NO: 15933 - protein, 526 aa, Homo Sapiens
MPQQLLITLPTEASTWVKLQHPKKAVEGAPLWEDVTKMFEGEALLSQDAEDVKTQRESLEDEVTPGLPTAESQELLTFKDISIDFTQEEWGQLAPAHQNLYREVMLENYSNLVSVGYQLSKPSVISQLEKGEEPWMAEKEGPGDPSSDLKSKIETIESTAKSTISQERLYHGIMMESFMRDDIIYSTLRKVSTYDDVLERHQETCMRDVRQAILTHKKRVQETNKFGENIIVHSNVIIEQRHHKYDTPTKRNTYKLDLINHPTSYIRTKTYECNICEKIFKQPIHLTEHMRIHTGEKPFRCKECGRAFSQSASLSTHQRIHTGEKPFECEECGKAFRHRSSLNQHHRTHTGEKPYVCDKCQKAFSQNISLVQHLRTHSGEKPFTCNECGKTFRQIRHLSEHIRIHTGEKPYACTACCKTFSHRAYLTHHQRIHTGERPYKCKECGKAFRQRIHLSNHKTVHTGVKAYECNRCGKAYRHDSSFKKHQRHHTGEKPYECNECGKAFSYNSSLSRHHEIHRRNAFRNKV

SEQ ID NO: 15934 - protein, 534 aa, Homo Sapiens
MLQQLLITLPTEASTWVKLRHPKAATERVALWEDVTKMFKAEALLSQDADETQGESLESRVTLGSLTAESQELLTFKDVSVDFTQEEWGQLAPAHRNLYREVMLENYGNLVSVGCQLSKPGVISQLEKGEEPWLMERDISGVPSSDLKSKTKTKESALQNDISWEELHCGLMMERFTKGSSMYSTLGRISKCNKLESQQENQRMGKGQIPLMCKKTFTQERGQESNRFEKRINVKSEVMPGPIGLPRKRDRKYDTPGKRSRYNIDLVNHSRSYTKMKTFECNICEKIFKQLIHLTEHMRIHTGEKPFRCKECGKAFSQSSSLIPHQRIHTGEKPYECKECGKTFRHPSSLTQHVRIHTGEKPYECRVCEKAFSQSIGLIQHLRTHVREKPFTCKDCGKAFFQIRHLRQHEIIHTGVKPYICNVCSKTFSHSTYLTQHQRTHTGERPYKCKECGKAFSQRIHLSIHQRVHTGVKPYECSHCGKAFRHDSSFAKHQRIHTGEKPYDCNECGKAFSCSSSLIRHCKTHLRNTFSNVV

SEQ ID NO: 15935 - protein, 532 aa, Homo Sapiens
MALRSVMFSDVSIDFSPEEWEYLDLEQKDLYRDVMLENYSNLVSLGCFISKPDVISSLEQGKEPWKVVRKGRRQYPDLETKYETKKLSLENDIYEINLSQWKIMERIENHGLKGLILKNDWESTGKIEGQERPQEGYFSSVKMPSEKVSSYQKRTSVTPHQRLHFVDKPYECKECGKAFRVRQQLTFHHRIHTGEKPYECKECGMAFRQTAHLTRHQRLHSGEKLYECKECGEAFICGADLRVHQKMHIGEKPYECKECGKAFRVRGQLTLHQRIHTGEKPYVCKECGKAFRQYAHLTRHQKLNSADRLYECKECGKAFLCGSGLRVHHKLHTGEKPYECKECGKAFRVRQQLTLHQRIHTGEKPYECKECGKTFSRGYHLILHHRIHTGEKPYECKECWKAFSRYSQLISHQSIHIGVKPYDCKECGKAFRLLSQLTQHQSIHIGEKPYKCKECGKAFRLRQKLTLHQSIHTGEKPFECKECRKAFRLNSSLIQHLRIHSGEKPYECKECKKAFRQHSHLTHHLKIHNVKI

SEQ ID NO: 15936 - protein, 636 aa, Homo Sapiens
MAPRPPTAAPQESVTFKDVSVDFTQEEWYHVDPAQRSLYRDVMLENYSHLVSLGYQVSKPEVIFKLEQGEEPWISEGEIQRPFYPDWKTRPEVKSSHLQQDVSEVSHCTHDLLHATLEDSWDVSSQLDRQQENWKRHLGSEASTQKKIITPQENFEQNKFGENSRLNTNLVTQLNIPARIRPSECETLGSNLGHNADLLNENNILAKKKPYKCDKCRKAFIHRSSLTKHEKTHKGEGAFPNGTDQGIYPGKKHHECTDCGKTFLWKTQLTEHQRIHTGEKPFECNVCGKAFRHSSSLGQHENAHTGEKPYQCSLCGKAFQRSSSLVQHQRIHTGEKPYRCNLCGRSFRHGTSLTQHEVTHSGEKPFQCKECGKAFSRCSSLVQHERTHTGEKPFECSICGRAFGQSPSLYKHMRIHKRGKPYQSSNYSIDFKHSTSLTQDESTLTEVKSYHCNDCGEDFSHITDFTDHQRIHTAENPYDCEQAFSQQAISHPGEKPYQCNVCGKAFKRSTSFIEHHRIHTGEKPYECNECGEAFSRRSSLTQHERTHTGEKPYECIDCGKAFSQSSSLIQHERTHTGEKPYECNECGRAFRKKTNLHDHQRIHTGEKPYSCKECGKNFSRSSALTKHQRIHTRNKL

SEQ ID NO: 15937 - protein, 570 aa, Homo Sapiens
MPGETEEPRPPEQQDQEGGEAAKAAPEEPQQRPPEAVAAAPAGTTSSRVLRGGRDRGRAAAAAAAAAVSRRRKAEYPRRRRSSPSARPPDVPGQQPQAAKSPSPVQGKKSPRLLCIEKVTTDKDPKEEKEEEDDSALPQEVSIAASRPSRGWRSSRTSVSRHRDTENTRSSRSKTGSLQLICKSEPNTDQLDYDVGEEHQSPGGISSEEEEEEEEEMLISEEEIPFKDDPRDETYKPHLERETPKPRRKSGKVKEEKEKKEIKVEVEVEVKEEENEIREDEEPPRKRGRRRKDDKSPRLPKRRKKPPIQYVRCEMEGCGTVLAHPRYLQHHIKYQHLLKKKYVCPHPSCGRLFRLQKQLLRHAKHHTDQRDYICEYCARAFKSSHNLAVHRMIHTGEKPLQCEICGFTCRQKASLNWHMKKHDADSFYQFSCNICGKKFEKKDSVVAHKAKSHPEVLIAEALAANAGALITSTDILGTNPESLTQPSDGQGLPLLPEPLGNSTSGECLLLEAEGMSKSYCSGTERVSLMADGKIFVGSGSSGGTEGLVMNSDILGATTEVLIEDSDSAGP

SEQ ID NO: 15938 - protein, 416 aa, Homo Sapiens
MAAILLTTRPKVPVSFEDVSVYFTKTEWKLLDLRQKVLYKRVMLENYSHLVSLGFSFSKPHLISQLERGEGPWVADIPRTWATAGLHIGDRTQSKTSTSTQKHSGRQLPGADPQGGKEGQAARSSVLQRGAQGLGQSSAAGPQGPKGAEKRYLCQQCGKAFSRSSNLIKHRIIHSGEKPYACPECGKLFRRSFALLEHQRIHSGEKPYACPECSKTFTRSSNLIKHQVIHSGERPFACGDCGKLFRRSFALLEHARVHSGERPYACPECGKAFSRSSNLIEHQRTHRGEKPYACGQCAKAFKGVSQLIHHQRSHSGERPFACRECGKAFRGRSGLSQHRRVHSGEKPYECSDCGKAFGRRANLFKHQAVHGARRPAKAETARRLAGPGSTGPGSAVAATSPPRPSTAARPSRPSRR

SEQ ID NO: 15939 - protein, 1006 aa, Homo Sapiens
MSRRKQSNPRQIKRSLGDMEAREEVQLVGASHMEQKATAPEAPSPPSADVNSPPPLPPPTSPGGPKELEGQEPEPRPTEEEPGSPWSGPDELEPVVQDGQRRIRARLSLATGLSWGPFHGSVQTRASSPRQAEPSPALTLLLVDEACWLRTLPQALTEAEANTEIHRKDDALWCRVTKPVPAGGLLSVLLTAEPHSTPGHPVKKEPAEPTCPAPAHDLQLLPQQAGMASILATAVINKDVFPCKDCGIWYRSERNLQAHLLYYCASRQGTGSPAAAATDEKPKETYPNERVCPFPQCRKSCPSASSLEIHMRSHSGERPFVCLICLSAFTTKANCERHLKVHTDTLSGVCHSCGFISTTRDILYSHLVTNHMVCQPGSKGEIYSPGAGHPATKLPPDSLGSFQQQHTALQGPLASADLGLAPTPSPGLDRKALAEATNGEARAEPLAQNGGSSEPPAAPRSIKVEAVEEPEAAPILGPGEPGPQAPSRTPSPRSPAPARVKAELSSPTPGSSPVPGELGLAGALFLPQYVFGPDAAPPASEILAKMSELVHSRLQQGAGAGAGGAQTGLFPGAPKGATCFECEITFSNVNNYYVHKRLYCSGRRAPEDAPAARRPKAPPGPARAPPGQPAEPDAPRSSPGPGAREEGAGGAATPEDGAGGRGSEGSQSPGSSVDDAEDDPSRTLCEACNIRFSRHETYTVHKRYYCASRHDPPPRRPAAPPGPPGPAAPPAPSPAAPVRTRRRRKLYELHAAGAPPPPPPGHAPAPESPRPGSGSGSGPGLAPARSPGPAADGPIDLSKKPRRPLPGAPAPALADYHECTACRVSFHSLEAYLAHKKYSCPAAPPPGALGLPAAACPYCPPNGPVRGDLLEHFRLAHGLLLGAPLAGPGVEARTPADRGPSPAPAPAASPQPGSRGPRDGLGPEPQEPPPGPPPSPAAAPEAVPPPPAPPSYSDKGVQTPSKGTPAPLPNGNHRYCRLCNIKFSSLSTFIAHKKYYCSSHAAEHVK

SEQ ID NO: 15940 - protein, 1151 aa, Homo Sapiens
MSRRKQSKPRQIKRPLEDAIEDEEEECPSEETDIISKGDFPLEESFSTEFGPENLSCEEVEYFCNKGDDEGIQETAESDGDTQSEKPGQPGVETDDWDGPGELEVFQKDGERKIQSRQQLPVGTTWGPFPGKMDLNNNSLKTKAQVPMVLTAGPKWLLDVTWQGVEDNKNNCIVYSKGGQLWCTTTKAISEGEELIAFVVDFDSRLQAASQMTLTEGMYPARLLDSIQLLPQQAAMASILPTAIVNKDIFPCKSCGIWYRSERNLQAHLMYYCSGRQREAAPVSEENEDSAHQISSLCPFPQCTKSFSNARALEMHLNSHSGVKMEEFLPPGASLKCTVCSYTADSVINFHQHLFSHLTQAAFRCNHCHFGFQTQRELLQHQELHVPSGKLPRESDMEHSPSATEDSLQPATDLLTRSELPQSQKAMQTKDASSDTELDKCEKKTQLFLTNQRPEIQPTTNKQSFSYTKIKSEPSSPRLASSPVQPNIGPSFPVGPFLSQFSFPQDITMVPQASEILAKMSELVHRRLRHGSSSYPPVIYSPLMPKGATCFECNITFNNLDNYLVHKKHYCSSRWQQMAKSPEFPSVSEKMPEALSPNTGQTSINLLNPAAHSADPENPLLQTSCINSSTVLDLIGPNGKGHDKDFSTQTKKLSTSSNNDDKINGKPVDVKNPSVPLVDGESDPNKTTCEACNITFSRHETYMVHKQYYCATRHDPPLKRSASNKVPAMQRTMRTRKRRKMYEMCLPEQEQRPPLVQQRFLDVANLNNPCTSTQEPTEGLGECYHPRCDIFPGIVSKHLETSLTINKCVPVSKCDTTHSSVSCLEMDVPIDLSKKCLSQSERTTTSPKRLLDYHECTVCKISFNKVENYLAHKQNFCPVTAHQRNDLGQLDGKVFPNPESERNSPDVSYERSIIKCEKNGNLKQPSPNGNLFSSHLATLQGLKVFSEAAQLIATKEENRHLFLPQCLYPGAIKKAKGADQLSPYYGIKPSDYISGSLVIHNTDIEQSRNAENESPKGQASSNGCAALKKDSLPLLPKNRGMVIVNGGLKQDERPAANPQQENISQNPQHEDDHKSPSWISENPLAANENVSPGIPSAEEQLSSIAKGVNGSSQAPTSGKYCRLCDIQFNNLSNFITHKKFYCSSHAAEHVK

SEQ ID NO: 15941 - protein, 805 aa, Homo Sapiens
MDEDGLELQQEPNSFFDATGADGTHMDGDQIVVEVQETVFVSDVVDSDITVHNFVPDDPDSVVIQDVIEDVVIEDVQCPDIMEEADVSETVIIPEQVLDSDVTEEVSLAHCTVPDDVLASDITSASMSMPEHVLTGDSIHVSDVGHVGHVGHVEHVVHDSVVEAEIVTDPLTTDVVSEEVLVADCASEAVIDANGIPVDQQDDDKGNCEDYLMISLDDAGKIEHDGSSGMTMDTESEIDPCKVDGTCPEVIKVYIFKADPGEDDLGGTVDIVESEPENDHGVELLDQNSSIRVPREKMVYMTVNDSQPEDEDLNVAEIADEVYMEVIVGEEDAAAAAAAAAVHEQQMDDNEIKTFMPIAWAAAYGNNSDGIENRNGTASALLHIDESAGLGRLAKQKPKKRRRPDSRQYQTAIIIGPDGHPLTVYPCMICGKKFKSRGFLKRHMKNHPEHLAKKKYRCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEVQQHALIHQESKTHQCLHCDHKSSNSSDLKRHIISVHTKDYPHKCDMCDKGFHRPSELKKHVAAHKGKKMHQCRHCDFKIADPFVLSRHILSVHTKDLPFRCKRCRKGFRQQSELKKHMKTHSGRKVYQCEYCEYSTTDASGFKRHVISIHTKDYPHRCEYCKKGFRRPSEKNQHIMRHHKEVGLP

SEQ ID NO: 15942 - protein, 801 aa, Homo Sapiens
MDEDEFELQPQEPNSFFDGIGADATHMDGDQIVVEIQEAVFVSNIVDSDITVHNFVPDDPDSVVIQDVVEDVVIEEDVQCSDILEEADVSENVIIPEQVLDSDVTEEVSLPHCTVPDDVLASDITSTSMSMPEHVLTSESMHVCDIGHVEHMVHDSVVEAEIITDPLTSDIVSEEVLVADCAPEAVIDASGISVDQQDNDKASCEDYLMISLDDAGKIEHDGSTGVTIDAESEMDPCKVDSTCPEVIKVYIFKADPGEDDLGGTVDIVESEPENDHGVELLDQNSSIRVPREKMVYMTVNDSQQEDEDLNVAEIADEVYMEVIVGEEDAAVAAAAAAVHEQQIDEDEMKTFVPIAWAAAYGNNSDGIENRNGTASALLHIDESAGLGRLAKQKPKKKRRPDSRQYQTAIIIGPDGHPLTVYPCMICGKKFKSRGFLKRHMKNHPEHLAKKKYHCTDCDYTTNKKISLHNHLESHKLTSKAEKAIECDECGKHFSHAGALFTHKMVHKEKGANKMHKCKFCEYETAEQGLLNRHLLAVHSKNFPHICVECGKGFRHPSELRKHMRIHTGEKPYQCQYCEYRSADSSNLKTHIKTKHSKEMPFKCDICLLTFSDTKEVQQHTLVHQESKTHQCLHCDHKSSNSSDLKRHVISVHTKDYPHKCEMCEKGFHRPSELKKHVAVHKGKKMHQCRHCDFKIADPFVLSRHILSVHTKDLPFRCKRCRKGFRQQNELKKHMKTHSGRKVYQCEYCEYSTTDASGFKRHVISIHTKDYPHRCEYCKKGFRRPSEKNQHIMRHHKEVGLP

SEQ ID NO: 15943 - protein, 2539 aa, Homo Sapiens [sequence omitted]

SEQ ID NO: 15944 - protein, 271 aa, Homo Sapiens
MTEPQVGCVACPRVHKEPAQVGTPWPAKPRSHPRKRDPTALLPRSLWPACQESVTALCFLQETVERLGQSPAQDTPVLGPCWDPMALGTQGRLLLDRDSKDTQTRISQKGRRLQPPGTPSAPPQRRPRKQLNPCRGTERVDPGFEGVTLKFQIKPDSSLQIIPTYSLPCSSRSQESPADAVGGPAAHPGGTEAHSAGSEALEPRRCASCRTQRTPLWRDAEDGTPLCNACGIRYKKYGTRCSSCWLVPRKNVQPKRLCGRCGVSLDPIQEG

SEQ ID NO: 15945 - protein, 531 aa, Homo Sapiens
MDEESLESALQTYRAQLQQVELALGAGLDSSEQADLRQLQGDLKELIELTEASLVSVRKSSLLAALDEERPGRQEDAEYQAFREAITEAVEAPAAARGSGSETVPKAEAGPESAAGGQEEEEGEDEEELSGTKVSAPYYSSWGTLEYHNAMVVGTEEAEDGSAGVRVLYLYPTHKSLKPCPFFLEGKCRFKENCRFSHGQVVSLDELRPFQDPDLSSLQAGSACLAKHQDGLWHAARITDVDNGYYTVKFDSLLLREAVVEGDGILPPLRTEATESDSDSDGTGDSSYARVVGSDAVDSAQSSALCPSLAVVGSDAVDSGTCSSAFAGWEVHTRGIGSRLLTKMGYEFGKGLGRHAEGRVEPIHAVVLPRGKSLDQCVETLQKQTRVGKAGTNKPPRCRGRGARPGGRPAPRNVFDFLNEKLQGQAPGALEAGAAPAGRRSKDMYHASKSAKRALSLRLFQTEEKIERTQRDIRSIQEALARNAGRHSVASAQLQEKLAGAQRQLGQLRAQEAGLQQEQRKADTHKKMTEF

SEQ ID NO: 15946 - protein, 873 aa, Homo Sapiens
MASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 15947 - protein, 837 aa, Homo Sapiens
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSITTSGPGTGDSDSGISVSKTPIMKPGKPKADAKKVPKKPEEITPENHVEGTARLVTDTAEILSRLGGVELLQDTLGHVMPSVQLPPNINLVPKVPVPLNTTKYNSALDTNATMINSFNKFPYPTQAELSWLTAASKHPEEHIRIWFATQRLKHGISWSPEEVEEARKKMFNGTIQSVPPTITVLPAQLAPTKVTQPILQTALPCQILGQTSLVLTQVTSGSTTVSCSPITLAVAGVTNHGQKRPLVTPQAAPEPKRPHIAQVPEPPPKVANPPLTPASDRKKTKEQIAHLKASFLQSQFPDDAEVYRLIEVTGLARSEIKKWFSDHRYRCQRGIVHITSESLAKDQLAIAASRHGRTYHAYPDFAPQKFKEKTQGQVKILEDSFLKSSFPTQAELDRLRVETKLSRREIDSWFSERRKLRDSMEQAVLDSMGSGKKGQDVGAPNGALSRLDQLSGAQLTSSLPSPSPAIAKSQEQVHLLRSTFARTQWPTPQEYDQLAAKTGLVRTEIVRWFKENRCLLKTGTVKWMEQYQHQPMADDHGYDAVARKATKPMAESPKNGGDVVPQYYKDPKKLCEEDLEKLVTRVKVGSEPAKDCLPAKPSEATSDRSEGSSRDGQGSDENEESSVVDYVEVTVGEEDAISDRSDSWSQAAAEGVSELAESDSDCVPAEAGQA

SEQ ID NO: 15948 - protein, 956 aa, Homo Sapiens
MASKRKSTTPCMIPVKTVVLQDASMEAQPAETLPEGPQQDLPPEASAASSEAAQNPSSTDGSTLANGHRSTLDGYLYSCKYCDFRSHDMTQFVGHMNSEHTDFNKDPTFVCSGCSFLAKTPEGLSLHNATCHSGEASFVWNVAKPDNHVVVEQSIPESTSTPDLAGEPSAEGADGQAEIIITKTPIMKIMKGKAEAKKIHTLKENVPSQPVGEALPKLSTGEMEVREGDHSFINGAVPVSQASASSAKNPHAANGPLIGTVPVLPAGIAQFLSLQQQPPVHAQHHVHQPLPTAKALPKVMIPLSSIPTYNAAMDSNSFLKNSFHKFPYPTKAELCYLTVVTKYPEEQLKIWFTAQRLKQGISWSPEEIEDARKKMFNTVIQSVPQPTITVLNTPLVASAGNVQHLIQAALPGHVVGQPEGTGGGLLVTQPLMANGLQATSSPLPLTVTSVPKQPGVAPINTVCSNTTSAVKVVNAAQSLLTACPSITSQAFLDASIYKNKKSHEQLSALKGSFCRNQFPGQSEVEHLTKVTGLSTREVRKWFSDRRYHCRNLKGSRAMIPGDHSSIIIDSVPEVSFSPSSKVPEVTCIPTTATLATHPSAKRQSWHQTPDFTPTKYKERAPEQLRALESSFAQNPLPLDEELDRLRSETKMTRREIDSWFSERRKKVNAEETKKAEENASQEEEEAAEDEGGEEDLASELRVSGENGSLEMPSSHILAERKVSPIKINLKNLRVTEANGRNEIPGLGACDPEDDESNKLAEQLPGKVSCKKTAQQRHLLRQLFVQTQWPSNQDYDSIMAQTGLPRPEVVRWFGDSRYALKNGQLKWYEDYKRGNFPPGLLVIAPGNRELLQDYYMTHKMLYEEDLQNLCDKTQMSSQQVKQWFAEKMGEETRAVADTGSEDQGPGTGELTAVHKGMGDTYSEVSENSESWEPRVPEASSEPFDTSSPQAGRQLETD

SEQ ID NO: 15949 - protein, 447 aa, Homo Sapiens
MLLDAGPQYPAIGVTTFGASRHHSAGDVAERDVGLGINPFADGMGAFKLNPSSHELASAGQTAFTSQAPGYAAAAALGHHHHPGHVGSYSSAAFNSTRDFLFRNRGFGDAAAAASAQHSLFAASAGGFGGPHGHTDAAGHLLFPGLHEQAAGHASPNVVNGQMRLGFSGDMYPRPEQYGQVTSPRSEHYAAPQLHGYGPMNVNMAAHHGAGAFFRYMRQPIKQELICKWIEPEQLANPKKSCNKTFSTMHELVTHVTVEHVGGPEQSNHICFWEECPREGKPFKAKYKLVNHIRVHTGEKPFPCPFPGCGKVFARSENLKIHKRTHTGEKPFKCEFEGCDRRFANSSDRKKHMHVHTSDKPYLCKMCDKSYTHPSSLRKHMKVHESSSQGSQPSPAASSGYESSTPPTIVSPSTDNPTTSSLSPSSSAVHHTAGHSALSSNFNEWYV

SEQ ID NO: 15950 - protein, 532 aa, Homo Sapiens
MLLDAGPQFPAIGVGSFARHHHHSAAAAAAAAAEMQDRELSLAAAQNGFVDSAAAHMGAFKLNPGAHELSPGQSSAFTSQGPGAYPGSAAAAAAAAALGPHAAHVGSYSGPPFNSTRDFLFRSRGFGDSAPGGGQHGLFGPGAGGLHHAHSDAQGHLLFPGLPEQHGPHGSQNVLNGQMRLGLPGEVFGRSEQYRQVASPRTDPYSAAQLHNQYGPMNMNMGMNMAAAAAHHHHHHHHHPGAFFRYMRQQCIKQELICKWIDPEQLSNPKKSCNKTFSTMHELVTHVSVEHVGGPEQSNHVCFWEECPREGKPFKAKYKLVNHIRVHTGEKPFPCPFPGCGKVFARSENLKIHKRTHTGEKPFQCEFEGCDRRFANSSDRKKHMHVHTSDKPYLCKMCDKSYTHPSSLRKHMKVHESSPQGSESSPAASSGYESSTPPGLVSPSAEPQSSSNLSPAAAAAAAAAAAAAAAVSAVHRGGGSGSGGAGGGSGGGSGSGGGGGGAGGGGGGSSGGGSGTAGGHSGLSSNFNEWYV

SEQ ID NO: 15951 - protein, 467 aa, Homo Sapiens
MTMLLDGGPQFPGLGVGSFGAPRHHEMPNREPAGMGLNPFGDSTHAAAAAAAAAAFKLSPAAAHDLSSGQSSAFTPQGSGYANALGHHHHHHHHHHHTSQVPSYGGAASAAFNSTREFLFRQRSSGLSEAASGGGQHGLFAGSASSLHAPAGIPEPPSYLLFPGLHEQGAGHPSPTGHVDNNQVHLGLRGELFGRADPYRPVASPRTDPYAAGAQFPNYSPMNMNMGVNVAAHHGPGAFFRYMRQPIKQELSCKWIDEAQLSRPKKSCDRTFSTMHELVTHVTMEHVGGPEQNNHVCYWEECPREGKSFKAKYKLVNHIRVHTGEKPFPCPFPGCGKIFARSENLKIHKRTHTGEKPFKCEFEGCDRRFANSSDRKKHMHVHTSDKPYICKVCDKSYTHPSSLRKHMKVHESQGSDSSPAASSGYESSTPPAIASANSKDTTKTPSAVQTSTSHNPGLPPNFNEWYV

SEQ ID NO: 15952 - protein, 334 aa, Homo Sapiens; identical to SEQ ID NO: 14389

SEQ ID NO: 15953 - protein, 663 aa, Homo Sapiens
MFLKAGRGNKVPPVRVYGPDCVVLMEPPLSKRNPPALRLADLATAQVQPLQNMTGFPALAGPPAHSQLRAAVAHLRLRDLGADPGVATTPLGPEHMAQASTLGLSPPSQAFPAHPEAPAAAARAAALVAHPGAGSYPCGGGSSGAQPSAPPPPAPPLPPTPSPPPPPPPPPPPALSGYTTTNSGGGGSSGKGHSRDFVLRRDLSATAPAAAMHGAPLGGEQRSGTGSPQHPAPPPHSAGMFISASGTYAGPDGSGGPALFPALHDTPGAPGGHPHPLNGQMRLGLAAAAAAAAAELYGRAEPPFAPRSGDAHYGAVAAAAAAALHGYGAVNLNLNLAAAAAAAAAGPGPHLQHHAPPPAPPPPPAPAQHPHQHHPHLPGAAGAFLRYMRQPIKQELICKWIDPDELAGLPPPPPPPPPPPPPPPAGGAKPCSKTFGTMHELVNHVTVEHVGGPEQSSHVCFWEDCPREGKPFKAKYKLINHIRVHTGEKPFPCPFPGCGKVFARSENLKIHKRTHTGEKPFKCEFDGCDRKFANSSDRKKHSHVHTSDKPYYCKIRGCDKSYTHPSSLRKHMKIHCKSPPPSPGPLGYSSVGTPVGAPLSPVLDPARSHSSTLSPQVTNLNEWYVCQASGAPSHLHTPSSNGTTSETEDEEIYGNPEVVRTIH

SEQ ID NO: 15954 - protein, 487 aa, Homo Sapiens
MAAAALRAPTQVTVSPETHMDLTKGCVTFEDIAIYFSQDEWGLLDEAQRLLYLEVMLENFALVASLGCGHGTEDEETPSDQNVSVGVSQSKAGSSTQKTQSCEMCVPVLKDILHLADLPGQKPYLVGECTNHHQHQKHHSAKKSLKRDMDRASYVKCCLFCMSLKPFRKWEVGKDLPAMLRLLRSLVFPGGKKPGTITECGEDIRSQKSHYKSGECGKASRHKHTPVYHPRVYTGKKLYECSKCGKAFRGKYSLVQHQRVHTGERPWECNECGKFFSQTSHLNDHRRIHTGERPYECSECGKLFRQNSSLVDHQKIHTGARPYECSQCGKSFSQKATLVKHQRVHTGERPYKCGECGNSFSQSAILNQHRRIHTGAKPYECGQCGKSFSQKATLIKHQRVHTGERPYKCGDCGKSFSQSSILIQHRRIHTGARPYECGQCGKSFSQKSGLIQHQVVHTGERPYECNKCGNSFSQCSSLIHHQKCHNT

SEQ ID NO: 15955 - protein, 527 aa, Homo Sapiens
MYQPEDDNNSDVTSDDDMTRNRRESSPPHSVHSFSGDRDWDRRGRSRDMEPRDRWSHTRNPRSRMPPRDLSLPVVAKTSFEMDREDDRDSRAYESRSQDAESYQNVVDLAEDRKPHNTIQDNMENYRKLLSLGFLAQDSVPAEKRNTEMLDNLPSAGSQFPDFKHLGTFLVFEELVTFEDVLVDFSPEELSSLSAAQRNLYREVMLENYRNLVSLGHQFSKPDIISRLEEEESYAMETDSRHTVICQGESHDDPLEPHQGNQEKLLTPITMNDPKTLTPERSYGSDEFERSSNLSKQSKDPLGKDPQEGTAPGICTSPQSASQENKHNRCEFCKRTFSTQVALRRHERIHTGKKPYECKQCAEAFYLMPHLNRHQKTHSGRKTSGCNEGRKPSVQCANLCERVRIHSQEDYFECFQCGKAFLQNVHLLQHLKAHEAARVLPPGLSHSKTYLIRYQRKHDYVGERACQCCDCGRVFSRNSYLIQHYRTHTQERPYQCQLCGKCFGRPSYLTQHYQLHSQEKTVECDHC

SEQ ID NO: 15956 - protein, 472 aa, Homo Sapiens
MNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLAREVPSINKETLTTQKGVECDGSKKILPLGIDDVSSLQHYVQNNSHDDNGYRKLVGNNPSKFVGQQLKCNACRKLFSSKSRLQSHLRRHACQKPFECHSCGRAFGEKWKLDKHQKTHAEERPYKCENCGNAYKQKSNLFQHQKMHTKEKPYQCKTCGKAFSWKSSCINHEKIHNAKKSYQCNECEKSFRQNSTLIQHKKVHTGQKPFQCTDCGKAFIYKSDLVKHQRIHTGEKPYKCSICEKAFSQKSNVIDHEKIHTGKRAYECDLCGNTFIQKKNLIQHKKIHTGEKPYECNRCGKAFFQKSNLHSHQKTHSGERTYRCSECGKTFIRKLNLSLHKKTHTGQKPYGCSECGKAFADRSYLVRHQKRIHSR

SEQ ID NO: 15957 - protein, 563 aa, Homo Sapiens
MMTAESREATGLSPQAAQEKDGIVIVKVEEEDEEDHMWGQDSTLQDTPPPDPEIFRQRFRRFCYQNTFGPREALSRLKELCHQWLRPEINTKEQILELLVLEQFLSILPKELQVWLQEYRPDSGEEAVTLLEDLELDLSGQQVPGQVHGPEMLARGMVPLDPVQESSSFDLHHEATQSHFKHSSRKPRLLQSRALPAAHIPAPPHEGSPRDQAMASALFTADSQAMVKIEDMAVSLILEEWGCQNLARRNLSRDNRQENYGSAFPQGGENRNENEESTSKAETSEDSASRGETTGRSQKEFGEKRDQEGKTGERQQKNPEEKTRKEKRDSGPAIGKDKKTITGERGPREKGKGLGRSFSLSSNFTTPEEVPTGTKSHRCDECGKCFTRSSSLIRHKIIHTGEKPYECSECGKAFSLNSNLVLHQRIHTGEKPHECNECGKAFSHSSNLILHQRIHSGEKPYECNECGKAFSQSSDLTKHQRIHTGEKPYECSECGKAFNRNSYLILHRRIHTREKPYKCTKCGKAFTRSSTLTLHHRIHARERASEYSPASLDAFGAFLKSCV

SEQ ID NO: 15958 - protein, 967 aa, Homo Sapiens
MAVALDSQIDAPLEVEGCLIMKVEKDPEWASEPILEGSDSSETFRKCFRQFCYEDVTGPHEAFSKLWELCCRWLKPEMRSKEQILELLVIEQFLTILPEKIQAWAQKQCPQSGEEAVALVVHLEKETGRLRQQVSSPVHREKHSPLGAAWEVADFQPEQVETQPRAVSREEPGSLHSGHQEQLNRKRERRPLPKNARPSPWVPALADEWNTLDQEVTTTRLPAGSQEPVKDVHVARGFSYRKSVHQIPAQRDLYRDFRKENVGNVVSLGSAVSTSNKITRLEQRKEPWTLGLHSSNKRSILRSNYVKEKSVHAIQVPARSAGKTWREQQQWGLEDEKIAGVHWSYEETKTFLAILKESRFYETLQACPRNSQVYGAVAEWLRECGFLRTPEQCRTKFKSLQKSYRKVRNGHMLEPCAFFEDMDALLNPAARAPSTDKPKEMIPVPRLKRIAISAKEHISLVEEEEAAEDSDDDEIGIEFIRKSEIHGAPVLFQNLSGVHWGYEETKTFLDILRETRFYEALQACHRKSKLYGAVAEQLRECGFLRTPEQCRTKFKSLQKSYRKVKNGHVLESCAFYKEMDALINSRASAPSPSTPEEVPSPSRQERGGIEVEPQEPTGWEPEETSQEAVIEDSCSERMSEEEIVQEPEFQGPPGLLQSPNDFEIGSSIKEDPTQIVYKDMEQHRALIEKSKRVVSQSTDPSKYRKRECISGRQWENLQGIRQGKPMSQPRDLGKAVVHQRPFVGKRPYRLLKYGESFGRSTRLMCRMTHHKENPYKCGVCGKCFGRSRSLIRHQRIHTGEKPFKCLDCGKSFNDSSNFGAHQRIHTGEKPYRCGECGKCFSQSSSLIIHQRTHTGEKPYQCGECGKSFTNSSHFSAHRRVHTGENPYKCVDCEKSFNNCTRFREHRRIHTGEKPYGCAQCGKRFSKSSVLTKHREVHVREKPLPHPPSLYCPENPHKGKTDEFRKTF

SEQ ID NO: 15959 - protein, 538 aa, Homo Sapiens
MARELSESTALDAQSTEDQMELLVIKVEEEEAGFPSSPDLGSEGSRERFRGFRYPEAAGPREALSRLRELCRQWLQPEMHSKEQILELLVLEQFLTILPGNLQSWVREQHPESGEEVVVLLEYLERQLDEPAPQVSGVDQGQELLCCKMALLTPAPGSQSSQFQLMKALLKHESVGSQPLQDRVLQVPVLAHGGCCREDKVVASRLTPESQGLLKVEDVALTLTPEWTQQDSSQGNLCRDEKQENHGSLVSLGDEKQTKSRDLPPAEELPEKEHGKISCHLREDIAQIPTCAEAGEQEGRLQRKQKNATGGRRHICHECGKSFAQSSGLSKHRRIHTGEKPYECEECGKAFIGSSALVIHQRVHTGEKPYECEECGKAFSHSSDLIKHQRTHTGEKPYECDDCGKTFSQSCSLLEHHRIHTGEKPYQCSMCGKAFRRSSHLLRHQRIHTGDKNVQEPEQGEAWKSRMESQLENVETPMSYKCNECERSFTQNTGLIEHQKIHTGEKPYQCNACGKGFTRISYLVQHQRSHVGKNILSQ

SEQ ID NO: 15960 - protein, 545 aa, Homo Sapiens
MAREPRKNAALDAQSAEDQTGLLTVKVEKEEASALTAEVRAPCSPARGPERSRQRFRGFRYPEAAGPREALSRLRELCGQWLQPEMHSKEQILELLVLEQFLTILPGNLQSWVREQHPESGEEVVVLLEYLERQLDEPAPQVPVGDQGQELLCCKMALLTQTQGSQSSQCQPMKALFKHESLGSQPLHDRVLQVPGLAQGGCCREDAMVASRLTPGSQGLLKMEDVALTLTPGWTQLDSSQVNLYRDEKQENHSSLVSLGGEIQTKSRDLPPVKKLPEKEHGKICHLREDIAQIPTHAEAGEQEGRLQRKQKNAIGSRRHYCHECGKSFAQSSGLTKHRRIHTGEKPYECEDCGKTFIGSSALVIHQRVHTGEKPYECEECGKVFSHSSNLIKHQRTHTGEKPYECDDCGKTFSQSCSLLEHHKIHTGEKPYQCNMCGKAFRRNSHLLRHQRIHGDKNVQNPEHGESWESQGRTESQWENTEAPVSYKCNECERSFTRNRSLIEHQKIHTGEKPYQCDTCGKGFTRTSYLVQHQRSHVGKKTLSQ

SEQ ID NO: 15961 - protein, 839 aa, Homo Sapiens
MIMTESREVIDLDPPAETSQEQEDLFIVKVEEEDCTWMQEYNPPTFETFYQRFRHFQYHEASGPREALSQLRVLCCEWLRPELHTKEQILELLVLEQFLTILPEEFQPWVREHHPESGEEAVAVIENIQRELEERRQQIVACPDVLPRKMATPGAVQESCSPHPLTVDTQPEQAPQKPRLLEENALPVLQVPSLPLKDSQELTASLLSTGSQKLVKIEEVADVAVSFILEEWGHLDQSQKSLYRDDRKENYGSITSMGYESRDNMELIVKQISDDSESHWVAPEHTERSVPQDPDFAEVSDLKGMVQRWQVNPTVGKSRQNPSQKRDLDAITDISPKQSTHGERGHRCSDCGKFFLQASNFIQHRRIHTGEKPFKCGECGKSYNQRVHLTQHQRVHTGEKPYKCQVCGKAFRVSSHLVQHHSVHSGERPYGCNECGKNFGRHSHLIEHLKRHFREKSQRCSDKRSKNTKLSVKKKISEYSEADMELSGKTQRNVSQVQDFGEGCEFQGKLDRKQGIPMKEILGQPSSKRMNYSEVPYVHKKSSTGERPHKCNECGKSFIQSAHLIQHQRIHTGEKPFRCEECGKSYNQRVHLTQHQRVHTGEKPYTCPLCGKAFRVRSHLVQHQSVHSGERPFKCNECGKGFGRRSHLAGHLRLHSREKSHQCRECGEIFFQYVSLIEHQVLHMGQKNEKNGICEEAYSWNLTVIEDKKIELQEQPYQCDICGKAFGYSSDLIQHYRTHTAEKPYQCDICRENVGQCSHTKQHQKIYSSTKSHQCHECGRGFTLKSHLNQHQRIHTGEKPFQCKECGMNFSWSCSLFKHLRSHERTDPINTLSVEGSLL

SEQ ID NO: 15962 - protein, 754 aa, Homo Sapiens
MTTAGRGNLGLIPRSTAFQKQEGRLTVKQEPANQTWGQGSSLQKNYPPVCEIFRLHFRQLCYHEMSGPQEALSRLRELCRWWLMPEVHTKEQILELLVLEQFLSILPGELRTWVQLHHPESGEEAVAVVEDFQRHLSGSEEVSAPAQKQEMHFEETTALGTTKESPPTSPLSGGSAPGAHLEPPYDPGTHHLPSGDFAQCTSPVPTLPQVGNSGDQAGATVLRMVRPQDTVAYEDLSVDYTQKKWKSLTLSQRALQWNMMPENHHSMASLAGENMMKGSELTPKQEFFKGSESSNRTSGGLFGVVPGAAETGDVCEDTFKELEGQTSDEEGSRLENDFLEITDEDKKKSTKDRYDKYKEVGEHPPLSSSPVEHEGVLKGQKSYRCDECGKAFNRSSHLIGHQRIHTGEKPYECNECGKTFRQTSQLIVHLRTHTGEKPYECSECGKAYRHSSHLIQHQRLHNGEKPYKCNECAKAFTQSSRLTDHQRTHTGEKPYECNECGEAFIRSKSLARHQVLHTGKKPYKCNECGRAFCSNRNLIDHQRIHTGEKPYECSECGKAFSRSKCLIRHQSLHTGEKPYKCSECGKAFNQNSQLIEHERIHTGEKPFECSECGKAFGLSKCLIRHQRLHTGEKPYKCNECGKSFNQNSHLIIHQRIHTGEKPYECNECGKVFSYSSSLMVHQRTHTGEKPYKCNDCGKAFSDSSQLIVHQRVHTGEKPYECSECGKAFSQRSTFNHHQRTHTGEKSSGLAWSVS

SEQ ID NO: 15963 - protein, 578 aa, Homo Sapiens
MAEESRKPSAPSPPDQTPEEDLVIVKVEEDHGWDQESSLHESNPLGQEVFRLRFRQLRYQETLGPREALIQLRALCHQWLRPDLNTKEQILELLVLEQFLTILPEELQTLVKEHQLENGEEVVTLLEDLERQIDILGRPVSARVHGHRVLWEEVVHSASAPEPPNTQLQSEATQHKSPVPQESQERAMSTSQSPTRSQKGSSGDQEMTATLLTAGFQTLEKIEDMAVSLIREEWLLDPSQKDLCRDNRPENFRNMFSLGGETRSENRELASKQVISTGIQPHGETAAKCNGDVIRGLEHEEARDLLGRLERQRGNPTQERRHKCDECGKSFAQSSGLVRHWRIHTGEKPYQCNVCGKAFSYRSALLSHQDIHNKVKRYHCKECGKAFSQNTGLILHQRIHTGEKPYQCNQCGKAFSQSAGLILHQRIHSGERPYECNECGKAFSHSSHLIGHQRIHTGEKPYECDECGKTFRRSSHLIGHQRSHTGEKPYKCNECGRAFSQKSGLIEHQRIHTGERPYKCKECGKAFNGNTGLIQHLRIHTGEKPYQCNECGKAFIQRSSLIRHQRIHSGEKSESISV

SEQ ID NO: 15964 - protein, 638 aa, Homo Sapiens
MESCSVTRLECSGAISAHCSLHLPGSSDSPASASQIAGTTDAIWNEQEKAELFTDKFCQVCGVMLQFESQRISHYEGEKHAQNVSFYFQMHGEQNEVPGKKMKMHVENFQVHRYEGVDKNKFCDLCNMMFSSPLIAQSHYVGKVHAKKLKQLMEEHDQASPSGFQPEMAFSMRTYVCHICSIAFTSLDMFRSHMQGSEHQIKESIVINLVKNSRKTQDSYQNECADYINVQKARGLEAKTCFRKMEESSLETRRYREVVDSRPRHRMFEQRLPFETFRTYAAPYNISQAMEKQLPHSKKTYDSFQDELEDYIKVQKARGLDPKTCFRKMRENSVDTHGYREMVDSGPRSRMCEQRFSHEASQTYQRPYHISPVESQLPQWLPTHSKRTYDSFQDELEDYIKVQKARGLEPKTCFRKIGDSSVETHRNREMVDVRPRHRMLEQKLPCETFQTYSGPYSISQVVENQLPHCLPAHDSKQRLDSISYCQLTRDCFPEKPVPLSLNQQENNSGSYSVESEVYKHLSSENNTADHQAGHKQKHQKRKRHLEEGKERPEKEQSKHKRKKSYEDTDLDKDKSIRQRKREEDRVKVSSGKLKHRKKKKSHDVPSEKEERKHRKEKKKSVEERTEEEMLWDESILGF

SEQ ID NO: 15965 - protein, 199 aa, Homo Sapiens
MASGSGTKNLDFRRKWDKDEYEKLAEKRLTEEREKKDGKPVQPVKRELLRHRDYKVDLESKLGKTIVITKTTPQSEMGGYYCNVCDCVVKDSINFLDHINGKKHQRNLGMSMRVERSTLDQVKKRFEVNKKKMEEKQKDYDFEERMKELREEEEKAKAYKKEKQKEKKRRAEEDLTFEEDDEMAAVMGFSGFGSTKKSY

SEQ ID NO: 15966 - protein, 289 aa, Homo Sapiens
MILLQHAVLPPPKQPSPSPPMSVATRSTGTLQLPPQKPFGQEASLPLAGEEELSKGGEQDCALEELCKPLYCKLCNVTLNSAQQAQAHYQGKNHGKKLRNYYAANSCPPPARMSNVVEPAATPVVPVPPQMGSFKPGGRVILATENDYCKLCDASFSSPAVAQAHYQGKNHAKRLRLAEAQSNSFSESSELGQRRARKEGNEFKMMPNRRNMYTVQNNSAGPYFNPRSRQRIPRDLAMCVTPSGQFYCSMCNVGAGEEMEFRQHLESKQHKSKVSEQRYRNEMENLGYV

SEQ ID NO: 15967 - protein, 229 aa, Homo Sapiens
MKSSDIDQDLFTDSYCKVCSAQLISESQRVAHYESRKHASKVRLYYMLHPRDGGCPAKRLRSENGSDADMVDKNKCCTLCNMSFTSAVVADSHYQGKIHAKRLKLLLGEKTPLKTTATPLSPLKPPRMDTAPVVASPYQRRDSDRYCGLCAAWFNNPLMAQQHYDGKKHKKNAARVALLEQLGTTLDMGELRGLRRNYRCTICSVSLNSIEQYHAHLKGSKHQTNLKNK

SEQ ID NO: 15968 - protein, 170 aa, Homo Sapiens
MGKRYFCDYCDRSFQDNLHNRKKHLNGLQHLKAKKVWYDMFRDAAAILLDEQNKRPCRKFLLTGQCDFGSNCRFSHMSERDLQELSIQVEEERRAREWLLDAPELPEGHLEDWLEKRAKRLSSAPSSRAEPIRTTVFQYPVGWPPVQELPPSLRAPPPGGWPLQPRVQWG

SEQ ID NO: 15969 - protein, 573 aa, Homo Sapiens
MDAKSLTAWSRTLVTFKDVFVDFTREEWKLLDTAQQIVYRNVMLENYKNLVSLGYQLTKPDVILRLEKGEEPWLVEREIHQETHPDSETAFEIKSSVSSRSIFKDKQSCDIKMEGMARNDLWYLSLEEVWKCRDQLDKYQENPERHLRQVAFTQKKVLTQERVSESGKYGGNCLLPAQLVLREYFHKRDSHTKSLKHDLVLNGHQDSCASNSNECGQTFCQNIHLIQFARTHTGDKSYKCPDNDNSLTHGSSLGISKGIHREKPYECKECGKFFSWRSNLTRHQLIHTGEKPYECKECGKSFSRSSHLIGHQKTHTGEEPYECKECGKSFSWFSHLVTHQRTHTGDKLYTCNQCGKSFVHSSRLIRHQRTHTGEKPYECPECGKSFRQSTHLILHQRTHVRVRPYECNECGKSYSQRSHLVVHHRIHTGLKPFECKDCGKCFSRSSHLYSHQRTHTGEKPYECHDCGKSFSQSSALIVHQRIHTGEKPYECCQCGKAFIRKNDLIKHQRIHVGEETYKCNQCGIIFSQNSPFIVHQIAHTGEQFLTCNQCGTALVNTSNLIGYQTNHIRENAY

SEQ ID NO: 15970 - protein, 542 aa, Homo Sapiens
MDDPRYGMCPLKGASGCPGAERSLLVQSYFEKGPLTFRDVAIEFSLEEWQCLDSAQQGLYRKVMLENYRNLVFLAGIALTKPDLITCLEQGKEPWNIKRHEMVAKPPVICSHFPQDLWAEQDIKDSFQEAILKKYGKYGHDNLQLQKGCKSVDECKVHKEHDNKLNQCLITTQSNIFQCDPSAKVFHTFSNSNRHKIRHTRKKPFKCKKCEKSFCMLLHLTQHKRFHITENSYQCKDCGKAFNWFSTLTTHRRIHTGEKPYKCEECGKAFNRSSHLTTHKIIHTGEKPYRCEECGKAFNRSSHLTTHKRIHTGVKPYKCTECGKAFNRSSHLTTHRIIHTGEKPYKCEECGKAFNQSSTLTTHKITHAGEKPYKCEECGKAFYRFSYLTKHKTSHTGEKFYKCEECGKGFNWSSALTKHKRIHTGEKPYKCEECGKAFNESSNLTTHKMIHTGEKPYKCDECGKAFNRSSQLTAHKMIHTGEKPYKCEECGKAFNRSSTLTKHKITHTGEKSYKWEECGKDFNQSLSLIKQNNSYWRETLQM

SEQ ID NO: 15971 - protein, 436 aa, Homo Sapiens
MDSVAFEDVAVNFTQEEWALLSPSQKNLYRDVTLETFRNLASVGIQWKDQDIENLYQNLGIKLRSLVERLCGRKEGNEHRETFSQIPDCHLNKKSQTGVKPCKCSVCGKVFLRHSFLDRHMRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKCKQCGKAFISAGYLRTHEIRSHALEKSHQCQECGKKLSCSSSLHRHERTHSGGKLYECQKCAKVFRCPTSLQAHERAHTGERPYECNKCGKTFNYPSCFRRHKKTHSGEKPYECTRCGKAFGWCSSLRRHEMTHTGEKPFDCKQCGKVFTFSNYLRLHERTHLAGRSQCFGRRQGDHLSPGV

SEQ ID NO: 15972 - protein, 1883 aa, Homo Sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQMEDMTMLWNKKSNKSNKYSHDRYNWQRQENDKLGTVATYRGPSEGFTSDKFPSEGLLDFNFEQLESQTTKQADTATSKVSGKNGSAAREKPRRWTPYPSQKTLDLQSGLKDITGNKSEMIEKPLFDFSLITTGIQEPQTDETRNSPTQKTQKEIHTGSLNHKASSDSAASFEVVRQCPTAEKPEQEHTPNKMPSLKSPLLPCPATKSLSQKQDPKNISKNTKTNFFSPGEHSNPSNKPTVEDNHGPYISKLRSSCPHVLKGNKSTFGSQKQSGDNLNDTLRKAKEVLQCHESLQNPLLSTSKSTRNYAKASRNVEESEKGSLKIEFQVHALEDESDGETSDTEKHGTKIGTLGSATTELLSGSTRTADEKEEDDRILKTSRELSTSPCNPIVRQKESELQMTSAASPHPGLLLDLKTSLEDAQVDDSIKSHVSYETEGFESASLDAELQKSDISQPSGPLLPELSKLGFPASLQRDLTRHISLKSKTGVHLPEPNLNSARRIRNISGHRKSETEKESGLKPTLRQILNASRRNVNWEQVIQQVTKKKQELGKGLPRFGIEMVPLVQNEQEALDLDGEPDLSSLEGFQWEGVSISSSPGLARKRSLSESSVIMDRAPSVYSFFSEEGTGKENEPQQMVSPSNSLRAGQSQKATMHLKQEVTPRAASLRTGERAENVATQRRHSAQLSSDHIIPLMHLAKDLNSQERSIPPSENQNSQESNGEGNCLSSSASSALAISSLADAATDSSCTSGAEQNDGQSIRKKRRATGDGSSPELPSLERKNKRRKIKGKKERSQVDQLLNISLREEELSKSLQCMDNNLLQARAALQTAYVEVQRLLMLKQQITMEMSALRTHRIQILQGLQETYEPSEHPDQVPCSLTRERRNSRSQTSIDAALLPTPFFPLFLEPPSSHVSPSPTGASLQITTSPTFQTHGSVPAPDSSVQIKQEPMSPEQDENVNAVPPSSACNVSKELLEANREISDSCPVYPVITARLSLPESTESFHEPSQELKFSVEQRNTRNRENSPSSQSAGLSSINKEGEEPTKGNSGSEACTSSFLRLSFASETPLEKEPHSPADQPEQQAESTLTSAETRGSKKKKKLRKKKSLRAAHVPENSDTEQDVLTVKPVRKVKAGKLIKGGKVTTSTWEDSRTGREQESVRDEPDSDSSLEVLEIPNPQLEVVAIDSSESGEEKPDSPSKKDIWNSTEQNPLETSRSGCDEVSSTSEIGTRYKDGIPVSVAETQTVISSIKGSKNSSEISSEPGDDDEPTEGSFEGHQAAVNAIQIFGNLLYTCSADKTVRVYNLVSRKCIGVFEGHTSKVNCLLVTQTSGKNAALYTGSSDHTIRCYNVKSRECVEQLQLEDRVLCLHSRWRILYAGLANGTVVTFNIKNNKRLEIFECHGPRAVSCLATAQEGARKLLVVGSYDCTISVRDARNGLLLRTLEGHSKTILCMKVVNDLVFSGSSDQSVHAHNIHTGELVRIYKGHNHAVTVVNILGKVMVTACLDKFVRVYELQSHDRLQVYGGHKDMIMCMTIHKSMIYTGCYDGSIQAVRLNLMQNYRCWWHGCSLIFGVVDHLKQHLLTDHTNPNFQTLKCRWKNCDAFFTARKGSKQDAAGHIERHAEDDSKIDS

SEQ ID NO: 15973 - protein, 783 aa, Homo Sapiens
MVAKPPVMSFHFAQDLWPEQNIKDSFQKVTLRRYGKCEYENLQLRKGCKHVDECTGHKGGHNTVNQCLTATPSKIFQCNKYVKVFDKFSNSNRYKRRHTGNKHFKCKECSKSFCVLSQLTQHRRIHTRVNSYKCEECGKAFNWFSTLTKHKRIHTGEKPYKCEECGKAFNQSSQLTRHKIIHTEEKPNKCEECGKAFKQASHLTIHKIIHTGEKPYKYEECGKVFSQSSHLTTQKILHTGENLYKCKECGKAFNLFSNLTNHKRIHAGEKPYKCKECGRAFNISSNLNKQEKIHTGGKLNKCEECDKAFNRSLKLTAHKKILMEEKPYKCEECGKVFNQFSTLTRHKIIHTGEKPYKCKECGKAFNQSSNLTEHKKIHTAEKSYKCEECGKAFNQHSNLINHRKIYSGEKPYKCEECGKAFNRSSTLTRHKKIHTGEKPYKCEECDRAFSQSSNLTEHKKIHTGEKPYKCEECGKAFNRFSTLTKHKRIHTGEKPYKCEECGKAFNQSYQLTRHKIVHTKEKLNKCEEFGKAFKQSSHRTIHKIIHTGEKPYKCEEHGKVFNQSSNLTTQKIIHTGENLYKFEEHGKAFNLFSNITNHKIIYTGEKPHKCEECGKAYNRFSNLTIHKRIHTGEKPYQCAECGKAFNCSSTLNRHKIIHTGEKPYKCKECGKAFNLSSTLTAHKKIHTGEKPYKCEECGKAFNQSSNLTTHKKIHTSEKPYKCEECGKSFNQFSSLNIHKIIHTGEKPYKCGDYGRAFNLSSNLTTHKKIHTGEKPYKCEYGKT

SEQ ID NO: 15974 - protein, 913 aa, Homo Sapiens
MTKFQEMVTFKDVAVVFTEEELGLLDSVQRKLYRDVMLENFRNLLLVAHQPFKPDLISQLEREEKLLMVETETPRDGCSGRKNQQKMESIQEVTVSYFSPKELSSRQTWQQSAGGLIRCQDFLKVFQGKNSQLQEQGNSLGQVWAGIPVQISEDKNYIFTHIGNGSNYIKSQGYPSWRAHHSWRKMYLKESHNYQCRCQQISMKNHFCKCDSVSWLSHHNDKLEVHRKENYSCHDCGEDIMKVSLLNQESIQTEEKPYPCTGYRKAFSNDSSSEVHQQFHLEGKPYTYSSCGKGCNYSSLLHIHQNIEREDDIENSHLKSYQRVHTEEKPCKCGEYGENFNHCSPLNTYELIHTGEMSYRHNIYEKAFSHSLDLNSIFRVHTRDEPHEYEENENVFNQSSCLQVHQKIHTEEKLYTDIEYGKSFICSSNLDIQHRVHMEENSYNSEECGNGFSLASHFQDLQIVHTKEQPYKRYVCSNSFSHNLYLQGHPKIHIGEKPRKEHGNGFNWSSKLKDHQRVHTGQKPYKCNICGKGFNHRSVLNVHQRVHTGEKPYKCEECDKGFSRSSYLQAHQRVHTGEKPYKCEECGKGFSRNSYLQGHQRVHTGEKPYKCEECGKGFSRSSHLQGHQRVHTGEKPFKCEECGKGFSWSFNLQIHQRVHTGEKPYKCEECGKGFSKASTLLAHQRVHTGEKPYQCDECGKSFSQRSYLQSHQSVHSGERPYICEVCGKGFSQRAYLQGHQRVHTRVKPYKCEMCGKGFSQSSRLEAHRRVHTGGKPYKCEVCTKGFSESSRLQAHQRVHVEGRPYKCEQCGKGFSGYSSLQAHHRVHTGEKPYKCEVCGKGFSQRSNLQAHQRVHTGEKPYKCDACGKGFRWSSGLLIHQRVHSSDKFYKSEDYGKDYPSSENLHRNEDSVLF

SEQ ID NO: 15975 - protein, 417 aa, Homo Sapiens
MSQDSVTFADVAVNFTKEEWTLLDPAQRNLYRDVMLENSRNLAFIDWATPCKTKDATPQPDILPKRTFPEANRVCLTSISSQHSTLREDWRCPKTEEPHRQGVNNVKPPAVAPEKDESPVSICEDHEMRNHSKPTCRLVPSQGDSIRQCILTRDSSIFKYNPVLNDSQKTHENNEDDGVLGWNIQWVPCGRKTELKSSTWTGSQNTVHHIRDEIDTGANRHQRNPFGKAFREDGSLRAHNTHGREKMYDFTQCENTSRNNSIHAMQMQLYTAETNKKDCQTGATSANAPNSGSHKSHCTGEKTHKCPECGRAFFYQSFLMRHMKIHTGEKPYECGKCGKAFRYSLHLNKHLRKHVVQKKPYECEECGKVIRESSKYTHIRSHTGEKPYKCKTCGKDFAKSSGLKKHLKTHKDEKPCE

SEQ ID NO: 15976 - protein, 483 aa, Homo Sapiens
MKRHEMVAKHLVMFYYFAQHLWPEQNIRDSFQKVTLRRYRKCGYENLQLRKGCKSVVECKQHKGDYSGLNQCLKTTLSKIFQCNKYVEVFHKISNSNRHKMRHTENKHFKCKECRKTFCMLSHLTQHKRIQTRVNFYKCEAYGRAFNWSSTLNKHKRIHTGEKPYKCKECGKAFNQTSHLIRHKRIHTEEKPYKCEECGKAFNQSSTLTTHNIIHTGEIPYKCEKCVRAFNQASKLTEHKLIHTGEKRYECEECGKAFNRSSKLTEHKYIHTGEKLYKCEECGKAFNQSSTLTTHKRIHSGEKPYKCEECGKAFKQFSNLTDHKKIHTGEKPYKCEECGKAFNQLSNLTRHKVIHTGEKPYKCGECGKAFNQSSALNTHKIIHTGENPHKCRESGKVFHLSSKLSTCKKIHTGEKLYKCEECGKAFNRSSTLIGHKRIHTGEKPYKCEECGKAFNQSSTLTTHKIIHTEEKQYKCDECGKAST

SEQ ID NO: 15977 - protein, 697 aa, Homo Sapiens
MNKSLGPVSFKDVAVDFTQEEWQQLDPEQKITYRDVMLENYSNLVSVGYHIIKPDVISKLEQGEEPWIVEGEFLLQSYPDEVWQTDDLIERIQEEENKPSRQTVFIETLIEERGNVPGKTFDVETNPVPSRKIAYKNSLCDSCEKCLTSVSEYISSDGSYARMKADECSGCGKSLLHIKLEKTHPGDQAYEFNQNGEPYTLNEESLYQKIRILEKPFEYIECQKAFQKDTVFVNHMEEKPYKWNGSEIAFLQMSDLTVHQTSHMEMKPYECSECGKSFCKKSKFIIHQRTHTGEKPYECNQCGKSFCQKGTLTVHQRTHTGEKPYECNECGKNFYQKLHLIQHQRTHSGEKPYECSYCGKSFCQKTHLTQHQRTHSGERPYVCHDCGKTFSQKSALNDHQKIHTGVKLYKCSECGKCFCRKSTLTTHLRTHTGEKPYECNECGKFFSRLSYLTVHYRTHSGEKPYECNECGKTFYLNSALMRHQRVHTGEKPYECNECGKLFSQLSYLTIHHRTHSGVKPYECSECGKTFYQNSALCRHRRIHKGEKPYECYICGKFFSQMSYLTIHHRIHSGEKPYECSECGKTFCQNSALNRHQRTHTGEKAYECYECGKCFSQMSYLTIHHRIHSGEKPFECNECGKAFSRMSYLTVHYRTHSGEKPYECTECGKKFYHKSAFNSHQRIHRRGNMNVIDVGRLL

SEQ ID NO: 15978 - protein, 390 aa, Homo Sapiens
MAEIHNGGELCDFMENGEIFSEHSCLNAHMGTENTGDTYDCDEYGENFPMLHNSAPAGETLSVLNQCRKAFSLPPNVHQRTWIGDKSFEYSDCEEAFVDQSHLQANRITHNGETLYEQKQCGRAFTYSTSHAVSVKMHTVEKPYECKECGKFFRYSSYLNSHMRTHTGEKPYECKECGKCFTVSSHLVEHVRIHTGEKPYQCKECGRAFAGRSGLTKHVRIHTGEKPYECNECGKAYNRFYLLTEHFKTHTEEKPFECKVCGKSFRSSSCLKNHFRIHTGIKPYKCKECGKAFTVSSSLHNHVKIHTGEKPYECKDCGKAFATSSQLIEHIRTHTGEKPYICKECGKTFRASSHLQKHVRIHTGEKPYICNECGKAYNRFYLLTKHLKTH

SEQ ID NO: 15979 - protein, 351 aa, Homo Sapiens
MSGHPGSWEMNSVAFEDVAVNFTQEEWALLDPSQKNLYRDVMQETFRNLASIGNKGEDQSIEDQYKNSSRNLRHIISHSGNNPYGCEECGKKPCTCKQCQKTSLSVTRVHRDTVMHTGNGHYGCTICEKVFNIPSSFQIHQRNHTGEKPYECMECGKALGFSRSLNRHKRIHTGEKRYECKQCGKAFSRSSHLRDHERTHTGEKPYECKHCGKAFRYSNCLHYHERTHTGEKPYVCMECGKAFSCLSSLQGHIKAHAGEEPYPCKQCGKAFRYASSLQKHEKTHIAQKPYVCNNCGKGFRCSSSLRDHERTHTGEKPYECQKCGKAFSRASTLWKHKKTHTGEKPYKCKKM

SEQ ID NO: 15980 - protein, 623 aa, Homo Sapiens
MEAEETMECLQEFPEHHKMILDRLNEQREQDRFTDITLIVDGHHFKAHKAVLAACSKFFYKFFQEFTQEPLVEIEGVSKMAFRHLIEFTYTAKLMIQGEEEANDVWKAAEFLQMLEAIKALEVRNKENSAPLEENTTGKNEAKKRKIAETSNVITESLPSAESEPVEIEVEIAEGTIEVEDEGIETLEEVASAKQSVKYIQSTGSSDDSALALLADITSKYRQGDRKGQIKEDGCPSDPTSKQVEGIEIVELQLSHVKDLFHCEKCNRSFKLFYHFKEHMKSHSTESFKCEICNKRYLRESAWKQHLNCYHLEEGGVSKKQRTGKKIHVCQYCEKQFDHFGHFKEHLRKHTGEKPFECPNCHERFARNSTLKCHLTACQTGVGAKKGRKKLYECQVCNSVFNSWDQFKDHLVIHTGDKPNHCTLCDLWFMQGNELRRHLSDAHNISERLVTEEVLSVETRVQTEPVTSMTIIEQVGKVHVLPLLQVQVDSAQVTVEQVHPDLLQDSQVHDSHMSELPEQVQVSYLEVGRIQTEEGTEVHVEELHVERVNQMPVEVQTELLEADLDHVTPEIMNQEERESSQADAAEAAREDHEDAEDLETKPTVDSEAEKAENEDRTALPVLE

SEQ ID NO: 15981 - protein, 706 aa, Homo Sapiens
MALPSPQVLMGLPALLMGPAQHTSWPCGSAVPTLKSMVTFEDVAVYFSQEEWELLDAAQRHLYHSVMLENLELVTSLGSWHGVEGEGAHPKQNVSVEVLQVRIPNADPSTKKANSCDMCGPFLKDILHLAEHQGTQSEEKPYTCGACGRDFWLNANLHQHQKEHSGGKPFRWYKDRDALMKSSKVHLSENPFTCREGGKVILGSCDLLQLQAVDSGQKPYSNLGQLPEVCTTQKLFECSNCGKAFLKSSTLPNHLRTHSEEIPFTCPTGGNFLEEKSILGNKKFHTGEIPHVCKECGKAFSHSSKLRKHQKFHTEVKYYECIACGKTFNHKLTFVHHQRIHSGERPYECDECGKAFSNRSHLIRHEKVHTGERPFECLKCGRAFSQSSNFLRHQKVHTQVRPYECSQCGKSFSRSSALIQHWRVHTGERPYECSECGRAFNNNSNLAQHQKVHTGERPFECSECGRDFSQSSHLLRHQKVHTGERPFECCDCGKAFSNSSTLIQHQKVHTGQRPYECSECRKSFSRSSSLIQHWRIHTGEKPYECSECGKAFAHSSTLIEHWRVHTKERPYECNECGKFFSQNSILIKHQKVHTGEKPYKCSECGKFFSRKSSLICHWRVHTGERPYECSECGRAFSSNSHLVRHQRVHTQERPYECIQCGKAFSERSTLVRHQKVHTRERTYECSQCGKLFSHLCNLAQHKKIHT

SEQ ID NO: 15982 - protein, 654 aa, Homo Sapiens
MAFRDVAVDFTQDEWRLLSPAQRTLYREVMLENYSNLVSLGISFSKPELITQLEQGKETWREEKKCSPATCPADPEPELYLDPFCPPGFSSQKFPMQHVLCNHPPWIFTCLCAEGNIQPGDPGPGDQEKQQQASEGRPWSDQAEGPEGEGAMPLFGRTKKRTLGAFSRPPQRQPVSSRNGLRGVELEASPAQSGNPEETDKLLKRIEVLGFGTVNCGECGLSFSKMTNLLSHQRIHSGEKPYVCGVCEKGFSLKKSLARHQKAHSGEKPIVCRECGRGFNRKSTLIIHERTHSGEKPYMCSECGRGFSQKSNLIIHQRTHSGEKPYVCRECGKGFSQKSAVVRHQRTHLEEKTIVCSDCGLGFSDRSNLISHQRTHSGEKPYACKECGRCFRQRTTLVNHQRTHSKEKPYVCGVCGHSFSQNSTLISHRRTHTGEKPYVCGVCGRGFSLKSHLNRHQNIHSGEKPIVCKDCGRGFSQQSNLIRHQRTHSGEKPMVCGECGRGFSQKSNLVAHQRTHSGERPYVCRECGRGFSHQAGLIRHKRKHSREKPYMCRQCGLGFGNKSALITHKRAHSEEKPCVCRECGQGFLQKSHLTLHQMTHTGEKPYVCKTCGRGFSLKSHLSRHRKTTSVHHRLPVQPDPEPCAGQPSDSLYSL

SEQ ID NO: 15983 - protein, 427 aa, Homo Sapiens
MTLVTAGGAWTGPGCWHEVKDEESSSEQSISIAVSHVNTSKAGLPAQTALPCDICGPILKDILHLDEHQGTHHGLKLHTCGACGRQFWFSANLHQYQKCYSIEQPLRRDKSEASIVKNCTVSKEPHPSEKPFTCKEEQKNFQATLGGCQQKAIHSKRKTHRSTESGDAFHGEQMHYKCSECGKAFSRKDTLVQHQRIHSGEKPYECSECGKAFSRKATLVQHQRIHTGERPYECSECGKTFSRKDNLTQHKRIHTGEMPYKCNECGKYFSHHSNLIVHQRVHNGARPYKCSDCGKVFRHKSTLVQHESIHTGENPYDCSDCGKSFGHKYTLIKHQRIHTESKPFECIECGKFFSRSSDYIAHQRVHTGERPFVCSKCGKDFIRTSHLVRHQRVHTGERPYECSECGKAYSLSSHLNRHQKVHTAGRL

SEQ ID NO: 15984 - protein, 658 aa, Homo Sapiens
MTPGVRVSTDPEQVTFEDVVVGFSQEEWGQLKPAQRTLYRDVMLDTFRLLVSVGHWLPKPNVISLLEQEAELWAVESRLPQGVYPDLETRPKVKLSVLKQGISEEISNSVILVERFLWDGLWYCRGEDTEGHWEWSCESLESLAVPVAFTPVKTPVLEQWQRNGFGENISLNPDLPHQPMTPERQSPHTWGTRGKREKPDLNVLQKTCVKEKPYKCQECGKAFSHSSALIEHHRTHTGERPYECHECLKGFRNSSALTKHQRIHTGEKPYKCTQCGRTFNQIAPLIQHQRTHTGEKPYECSECGKSFSFRSSFSQHERTHTGEKPYECSECGKAFRQSIHLTQHLRIHTGEKPYQCGECGKAFSHSSSLTKHQRIHTGEKPYECHECGKAFTQITPLIQHQRTHTGEKPYECGECGKAFSQSTLLTEHRRIHTGEKPYGCNECGKTFSHSSSLSQHERTHTGEKPYECSQCGKAFRQSTHLTQHQRIHTGEKPYECNDCGKAFSHSSSLTKHQRIHTGEKPYECNQCGRAFSQLAPLIQHQRIHTGEKPYECNQCGRAFSQSSLLIEHQRIHTKEKPYGCNECGKSFSHSSSLSQHERTHTGEKPYECHDCGKSFRQSTHLTQHRRIHTGEKPYACRDCGKAFTHSSSLTKHQRTHTG

SEQ ID NO: 15985 - protein, 540 aa, Homo Sapiens
MDSVAFEDVDVNFTQEEWALLDPSQKNLYRDVMWETMRNLASIGKKWKDQNIKDHYKHRGRNLRSHMLERLYQTKDGSQRGGIFSQFANQNLSKKIPGVKLCESIVYGEVSMGQSSLNRHIKDHSGHEPKEYQEYGEKPDTRNQCWKPFSSHHSFRTHEIIHTGEKLYDCKECGKTFFSLKRIRRHIITHSGYTPYKCKVCGKAFDYPSRFRTHERSHTGEKPYECQECGKAFTCITSVRRHMIKHTGDGPYKCKVCGKPFHSLSSFQVHERIHTGEKPFKCKQCGKAFSCSPTLRIHERTHTGEKPYECKQCGKAFSYLPSLRLHERIHTGEKPFVCKQCGKAFRSASTFQIHERTHTGEKPYECKECGEAFSCIPSMRRHMIKHTGEGPYKCKVCGKPFHSLSPFRIHERTHTGEKPYVCKHCGKAFVSSTSIRIHERTHTGEKPYECKQCGKAFSYLNSFRTHEMIHTGEKPFECKRCGKAFRSSSSFRLHERTHTGQKPYHCKECGKAYSCRASFQRHMLTHAEDGPPYKCMWESL

SEQ ID NO: 15986 - protein, 207 aa, Homo Sapiens
MNVARFLVEKHTLHVIIDFILSKVSNQQSNLAQHQRVYTGEKPYKCNEWGKALSGKSSLFYHQAIHGVGKLCKCNDCHKVFSNATTIANHWRIHNEDRSYKCNKCGKIFRHRSYLAVYQRTHTGEKPYKYHDCGKVFSQASSYAKHRRIHTGEKPHKCDDCGKVLTSRSHLIRHQRIHTGQKSYKCLKCGKVFSLWALHAEHQKIHF

SEQ ID NO: 15987 - protein, 262 aa, Homo Sapiens
MKRHEMVVAKHSALCSRFAQDLWLEQNIKDSFQKVTLSRYGKYGHKNLQLRKGCKSVDECKGHQGGFNGLNQCLKITTSKIFQCNKYVKVMHKFSNSNRHKIRHTENKHFRCKECDKSLCMLSRLTQHKKIHTRENFYKCEECGKTFNWSTNLSKPKKIHTGEKPYKCEVCGKAFHQSSILTKHKIIRTGEKPYKCAHCGKAFKQSSHLTRHKIIHTEEKPYKCEQCGKVFKQSPTLTKHQIIYTGEEPYKCEECGKAFNLS

SEQ ID NO: 15988 - protein, 642 aa, Homo Sapiens
MDSVSFEDVAVNFTLEEWALLDSSQKKLYEDVMQETFKNLVCLGKKWEDQDIEDDHRNQGKNRRCHMVERLCESRRGSKCGETTSQMPNVNINKETFTGAKPHECSFCGRDFIHHSSLNRHMRSHTGQKPNEYQEYEKQPCKCKAVGKTFSYHHCFRKHERTHTGVKPYECKQCGKAFIYYQPFQRHERTHAGQKPYECKQCGKTFIYYQSFQKHAHTGKKPYECKQCGKAFICYQSFQRHKRTHTGEKPYECKQCGKAFSCPTYFRTHERTHTGEKPYKCKECGKAFSFLSSFRRHKRTHSGEKPYECKECGKAFFYSASFRAHVIIHTGARPYKCKECGKAFNSSNSCRVHERTHIGEKPYECKRCGKSFSWSISLRLHERTHTGEKPYECKQCHKTFSFSSSLREHETTHTGEKPYECKQCGKTFSFSSSLQRHERTHNAEKPYECKQCGKAFRCSSYFRIHERSHTGEKPYECKQCGKVFIRSSSFRLHERTHTGEKPYECKLCGKTFSFSSSLREHEKIHTGNKPFECKQCGKAFLRSSQIRLHERTHTGEKPYQCKQCGKAFISSSKFRMHERTHTGEKPYRCKQCGKAFRFSSSVRIHERSHTGEKPYECKQCGKAFISSSHFRLHERTHMGEKV

SEQ ID NO: 15989 - protein, 457 aa, Homo Sapiens
MSQGSVTFRDVAIDFSQEEWKWLQPAQRDLYRCVMLENYGHLVSLGLSISKPDVVSLLEQGKEPWLGKREVKRDLFSVSESSGEIKDFSPKNVIYDDSSQYLIMERILSQGPVYSSFKGGWKCKDHTEMLQENQGCIRKVTVSHQEALAQHMNISTVERPYGCHECGKTFGRRFSLVLHQRTHTGEKPYACKECGKTFSQISNLVKHQMIHTGKKPHECKDCNKTFSYLSFLIEHQRTHTGEKPYECTECGKAFSRASNLTRHQRIHIGKKQYICRKCGKAFSSGSELIRHQITHTGEKPYECIECGKAFRRFSHLTRHQSIHTTKTPYECNECRKAFRCHSFLIKHQRIHAGEKLYECDECGKVFTWHASLIQHTKSHTGEKPYACAECDKAFSRSFSLILHQRTHTGEKPYVCKVCNKSFSWSSNLAKHQRTHTLDNPYEYENSFNYHSFLTEHQ

SEQ ID NO: 15990 - protein, 474 aa, Homo Sapiens
MELLTFRDVAIEFSPEEWKCLDPDQQNLYRDVMLENYRNLVSLGVAISNPDLVTCLEQRKEPYNVKIHKIVARPPAMCSHFTQDHWPVQGIEDSFHKLILRRYEKCGHDNLQLRKGCKSLNECKLQKGGYNEFNECLSTTQSKILQCKASVKVVSKFSNSNKRKTRHTGEKHFKECGKSFQKFSHLTQHKVIHAGEKPYTCEECGKAFKWSLIFNEHKRIHTGEKPFTCEECGSIFTTSSHFAKHKIIHTGEKPYKCEECGKAFNRFTTLTKHKRIHAGEKPITCEECRKIFTSSSNFAKHKRIHTGEKPYKCEECGKAFNRSTTLTKHKRIHTGEKPYTCEECGKAFRQSSKLNEHKKVHTGERPYKCDECGKAFGRSRVLNEHKKIHTGEKPYKCEECGKAFRRSTDRSQHKKIHSADKPYKCKECDKAFKQFSLLSQHKKIHTVDKPYKCKDCDKAFKRFSHLNKHKKIHT

SEQ ID NO: 15991 - protein, 1687 aa, Homo Sapiens
MTDPLLDSQPASSTGEMDGLCPELLLIPPPLSNRGILGPVQSPCPSRDPAPIPTEPGCLLVEATATEEGPGNMEIIVETVAGTLTPGAPGETPAPKLPPGEREPSQEAGTPLPGQETAEEENVEKEEKSDTQKDSQKAVDKGQGAQRLEGDVVSGTESLFKTHMCPECKRCFKKRTHLVEHLHLHFPDPSLQCPNCQKFFTSKSKLKTHLLRELGEKAHHCPLCHYSAVERNALNRHMASMHEDISNFYSDTYACPVCREEFRLSQALKEHLKSHTAAAAAEPLPLRCFQEGCSYAAPDRKAFIKHLKETHGVRAVECRHHSCPMLFATAEAMEAHHKSHYAFHCPHCDFACSNKHLFRKHKKQGHPGSEELRCTFCPFATFNPVAYQDHVGKMHAHEKIHQCPECNFATAHKRVLIRHMLLHTGEKPHKCELCDFTCRDVSYLSKHMLTHSNTKDYMCTECGYVTKWKHYLRVHMRKHAGDLRYQCNQCSYRCHRADQLSSHKLRHQGKSLMCEVCAFACKRKYELQKHMASQHHPGTPAPLYPCHYCSYQSRHKQAVLSHENCKHTRLREFHCALCDYRTFSNTTLLFHKRKAHGYVPGDQAWQLRYASQEPEGAMQGPTPPPDSEPSNQLSARPEGPGHEPGTVVDPSLDQALPEMSEEVNTGRQEGSEAPHGGDLGGSPSPAEVEEGSCTLHLEALGVELESVTEPPLEEVTETAPMEFRPLGLEGPDGLEGPELSSFEGIGTSDLSAEENPLLEKPVSEPSTNPPSLEEAPNNWVGTFKTTPPAETAPLPPLPESESLLKALRRQDKEQAEALVLEGRVQMVVIQGEGRAFRCPHCPFITRREKALNLHSRTGCQGRREPLLCPECGASFKQQRGLSTHLLKKCPVLLRKNKGLPRPDSPIPLQPVLPGTQASEDTESGKPPPASQEAELLLPKDAPLELPREPEETEEPLATVSGSPVPPAGNSLPTEAPKKHCFDPVPPAGNSSPTEAPKKHHLDPVPPAGNSSPTEALKKHRFEQGKFHCNSCPFLCSRLSSITSHVAEGCRGGRGGGGKRGTPQTQPDVSPLSNGDSAPPKNGSTESSSGDGDTVLVQKQKGARFSCPTCPFSCQQERALRTHQIRGCPLEESGELHCSLCPFTAPAATALRLHQKRRHPTAAPARGPRPHLQCGDCGFTCKQSRCMQQHRRLKHEGVKPHQCPFCDFSTTRRYRLEAHQSRHTGIGRIPCSSCPQTFGTNSKLRLHRLRVHDKTPTHFCPLCDYSGYLRHDITRHVNSCHQGTPAFACSQCEAQFSSETALKQHALRRHPEPAQPAPGSPAETTEGPLHCSRCGLLCPSPASLRGHTRKQHPRLECGACQEAFPSRLALDEHRRQQHFSHRCQLCDFAARERVGLVKHYLEQHEETSAAVAASDGDGDAGQPPLHCPFCDFTCRHQLVLDHHVKGHGGTRLYKCTDCAYSTKNRQKITWHSRIHTGEKPYHCHLCPYACADPSRLKYHMRIHKEERKYLCPECGYKCKWVNQLKYHMTKHTGLKPYQCPECEYCTNRADALRVHQETRHREARAFMCEQCGKAFKTRFLLRTHLRKHSEAKPYVCNVCHRAFRWAAGLRHHALTHTDRHPFFCRLCNYKAKQKFQVVKHVRRHHPDQADPNQGVGKDPTTPTVHLHDVQLEDPSPPAPAAPHTGPEG

SEQ ID NO: 15992 - protein, 638 aa, Homo Sapiens
MLLAQINRDSQGMTEFPGGGMEAQHVTLCLTEAVTVADGDNLENMEGVSLQAVTLADGSTAYIQHNSKDAKLIDGQVIQLEDGSAAYVQHVPIPKSTGDSLRLEDGQAVQLEDGTTAFIHHTSKDSYDQSALQAVQLEDGTTAYIHHAVQVPQSDTILAIQADGTVAGLHTGDATIDPDTISALEQYAAKVSIDGSESVAGTGMIGENEQEKKMQIVLQGHATRVTAKSQQSGEKAFRCEYDGCGKLYTTAHHLKVHERSHTGDRPYQCEHAGCGKAFATGYGLKSHVRTHTGEKPYRCSEDNCTKSFKTSGDLQKHIRTHTGERPFKCPFEGCGRSFTTSNIRKVHVRTHTGERPYYCTEPGCGRAFASATNYKNHVRIHTGEKPYVCTVPGCDKRFTEYSSLYKHHVVHTHSKPYNCNHCGKTYKQISTLAMHKRTAHNDTEPIEEEQEAFFEPPPGQGEDVLKGSQITYVTGVEGDDVVSTQVATVTQSGLSQQVTLISQDGTQHVNISQADMQAIGNTITMVTQDGTPITVPAHDAVISSAGTHSVAMVTAEGTEGEQVAIVAQDLAAFHTASSEMGHQQHSHHLVTTETRPLTLVATSNGTQIAVQLGEQPSLEEAIRIASRIQQGETPGLDD

SEQ ID NO: 15993 - protein, 292 aa, Homo Sapiens
MSHLSQQRIYSGENPFACKVCGKVFSHKSNLTEHEHFHTREKPFECNECGKAFSQKQYVIKHQNTHTGEKLFECNECGKSFSQKENLLTHQKIHTGEKPFECKDCGKAFIQKSNLIRHQRTHTGEKPFVCKECGKTFSGKSNLTEHEKIHIGEKPFKCSECGTAFGQKKYLIKHQNIHTGEKPYECNECGKAFSQRTSLIVHVRIHSGDKPYECNVCGKAFSQSSSLTVHVRSHTGEKPYGCNECGKAFSQFSTLALHLRIHTGKKPYQCSECGKAFSQKSHHIRHQKIHTH

SEQ ID NO: 15994 - protein, 794 aa, Homo Sapiens
MNIDDKLEGLFLKCGGIDEMQSSRTMVVMGGVSGQSTVSGELQDSVLQDRSMPHQEILAADEVLQESEMRQQDMISHDELMVHEETVKNDEEQMETHERLPQGLQYALNVPISVKQEITFTDVSEQLMRDKKQIREPVDLQKKKKRKQRSPAKILTINEDGSLGLKTPKSHVCEHCNAAFRTNYHLQRHVFIHTGEKPFQCSQCDMRFIQKYLLQRHEKIHTGEKPFRCDECGMRFIQKYHMERHKRTHSGEKPYQCEYCLQYFSRTDRVLKHKRMCHENHDKKLNRCAIKGGLLTSEEDSGFSTSPKDNSLPKKKRQKTEKKSSGMDKESALDKSDLKKDKNDYLPLYSSSTKVKDEYMVAEYAVEMPHSSVGGSHLEDASGEIHPPKLVLKKINSKRSLKQPLEQNQTISPLSTYEESKVSKYAFELVDKQALLDSEGNADIDQVDNLQEGPSKPVHSSTNYDDAMQFLKKKRYLQAASNNSREYALNVGTIASQPSVTQAAVASVIDESTTASILESQALNVEIKSNHDKNVIPDEVLQTLLDHYSHKANGQHEISFSVADTEVTSSISINSSEVPEVTPSENVGSSSQASSSDKANMLQEYSKFLQQALDRTSQNDAYLNSPSLNFVTDNQTLPNQPAFSSIDKQVYATMPINSFRSGMNSPLRTTPDKSHFGLIVGDSQHSFPFSGDETNHASATSTQDFLDQVTSQKKAEAQPVHQAYQMSSFEQPFRAPYHGSRAGIATQFSTANGQVNLRGPGTSAEFSEFPLVNVNDNRAGMTSSPDATTGQTFG

SEQ ID NO: 15995 - protein, 437 aa, Homo Sapiens
MAAATLRTPTQGTVTFEDVAVHFSWEEWGLLDEAQRCLYRDVMLENLALLTSLDVHHQKQHLGEKHFRSNVGRALFVKTCTFHVSGEPSTCREVGKDFLAKLGFLHQQAAHTGEQSNSKSDGGAISHRGKTHYNCGEHTKAFSGKHTLVQQQRTLTTERCYICSECGKSFSKSYSLNDHWRLHTGEKPYECRECGKSFRQSSSLIQHRRVHTAVRPHECDECGKLFSNKSNLIKHRRVHTGERPYECSECGKSFSQRSALLQHRGVHTGERPYECSECGKFFTYHSSLIKHQKVHSGSRPYECSECGKSFSQNSSLIEHHRVHTGERPYKCSECGKSFSQRSALLQHRGVHTGERPYECSECGKFFPYSSSLRKHQRVHTGSRPYECSECGKSFTQNSGLIKHRRVHTGEKPYECTECGKSFSHNSSLIKHQRIHSR

SEQ ID NO: 15996 - protein, 538 aa, Homo Sapiens
MTTFKEAVTFKDVAVVFTEEELGLLDPAQRKLYRDVMLENFRNLLSVGHQPFHQDTCHFLREEKFWMMGTATQREGNSGGKIQTELESVPEAGAHEEWSCQQIWEQIAKDLTRSQDSIINNSQFFENGDVPSQVEAGLPTIHTGQKPSQGGKCKQSISDVPIFDLPQQLYSEEKSYTCDECGKSICYISALHVHQRVHVGEKLFMCDVCGKEFSQSSHLQTHQRVHTGEKPFKCEQCGKGFSRRSALNVHRKLHTGEKPYICEACGKAFIHDSQLKEHKRIHTGEKPFKCDICGKTFYFRSRLKSHSMVHTGEKPFRCDTCDKSFHQRSALNRHCMVHTGEKPYRCEQCGKGFIGRLDFYKHQVVHTGEKPYNCKECGKSFRWSSCLLNHQRVHSGEKSFKCEECGKGFYTNSQLSSHQRSHSGEKPYKCEECGKGYVTKFNLDLHQRVHTGERPYNCKECGKNFSRASSILNHKRLHCQKKPFKCEDCGKRLVHRTYRKDQPRDYSGENPSKCEDCGRRYKRRLNLDILLSLFLNDT

SEQ ID NO: 15997 - protein, 506 aa, Homo Sapiens
MPANGTSPQRFPALIPGEPGRSFEGSVSFEDVAVDFTRQEWHRLDPAQRTMHKDVMLETYSNLASVGLCVAKPEMIFKLERGEELWILEEESSGHGYSGSLSLLCGNGSVGDNALRHDNDLLHHQKIQTLDQNVEYNGCRKAFHEKTGFVRRKRTPRGDKNFECHECGKAYCRKSNLVEHLRIHTGERPYECGECAKTFSARSYLIAHQKTHTGERPFECNECGKSFGRKSQLILHTRTHTGERPYECTECGKTFSEKATLTIHQRTHTGEKPYECSECGKTFRVKISLTQHHRTHTGEKPYECGECGKNFRAKKSLNQHQRIHTGEKPYECGECGKFFRMKMTLNNHQRTHTGEKPYQCNECGKSFRVHSSLGIHQRIHTGEKPYECNECGNAFYVKARLIEHQRMHSGEKPYECSECGKIFSMKKSLCQHRRTHTGEKPYECSECGNAFYVKVRLIEHQRIHTGERPFECQECGKAFCRKAHLTEHQRTHIGWSWRCTMKKASH

SEQ ID NO: 15998 - protein, 682 aa, Homo Sapiens
MPSLRTRREEAEMELSVPGPSPWTPAAQARVRDAPAVTHPGSAACGTPCCSDTELEAICPHYQQPDCDTRTEDKEFLHKEDIHEDLESQAEISENYAGDVSQVPELGDLCDDVSERDWGVPEGRRLPQSLSQEGDFTPAAMGLLRGPLGEKDLDCNGFDSRFSLSPNLMACQEIPTEERPHPYDMGGQSFQHSVDLTGHEGVPTAESPLICNECGKTFQGNPDLIQRQIVHTGEASFMCDDCGKTFSQNSVLKNRHRSHMSEKAYQCSECGKAFRGHSDFSRHQSHHSSERPYMCNECGKAFSQNSSLKKHQKSHMSEKPYECNECGKAFRRSSNLIQHQRIHSGEKPYVCSECGKAFRRSSNLIKHHRTHTGEKPFECGECGKAFSQSAHLRKHQRVHTGEKPYECNDCGKPFSRVSNLIKHHRVHTGEKPYKCSDCGKAFSQSSSLIQHRRIHTGEKPHVCNVCGKAFSYSSVLRKHQIIHTGEKPYRCSVCGKAFSHSSALIQHQGVHTGDKPYACHECGKTFGRSSNLILHQRVHTGEKPYECTECGKTFSQSSTLIQHQRIHNGLKPHECNQCGKAFNRSSNLIHHQKVHTGEKPYTCVECGKGFSQSSHLIQHQIIHTGERPYKCSECGKAFSQRSVLIQHQRIHTGVKPYDCAACGKAFSQRSKLIKHQLIHTRE

SEQ ID NO: 15999 - protein, 818 aa, Homo Sapiens
MALTQVRLTFRDVAIEFSQEEWKCLDPAQRILYRDVMLENYWNLVSLGLCHFDMNIISMLEEGKEPWTVKSCVKIARKPRTPECVKGVVTDIPPKCTIKDLLPKEKSSTEAVFHTVVLERHESPDIEDFSFKEPQKNVHDFECQWRDDTGNYKGVLMAQKEGKRDQRDRRDIENKLMNNQLGVSFHSHLPELQLFQGEGKMYECNQVEKSTNNGSSVSPLQQIPSSVQTHRSKKYHELNHFSLLTQRRKANSCGKPYKCNECGKAFTQNSNLTSHRRIHSGEKPYKCSECGKTFTVRSNLTIHQVIHTGEKPYKCHECGKVFRHNSYLATHRRIHTGEKPYKCNECGKAFRGHSNLTTHQLIHTGEKPFKCNECGKLFTQNSHLISHWRIHTGEKPYKCNECGKAFSVRSSLAIHQTIHTGEKPYKCNECGKVFRYNSYLGRHRRVHTGEKPYKCNECGKAFSMHSNLATHQVIHTGTKPFKCNECSKVFTQNSQLANHRRIHTGEKPYKCNECGKAFSVRSSLTTHQAIHSGEKPYKCIECGKSFTQKSHLRSHRGIHSGEKPYKCNECGKVFAQTSQLARHWRVHTGEKPYKCNDCGRAFSDRSSLTFHQAIHTGEKPYKCHECGKVFRHNSYLATHRRIHTGEKPYKCNECGKAFSMHSNLTTHKVIHTGEKPYKCNQCGKVFTQNSHLANHQRTHTGEKPYRCNECGKAFSVRSSLTTHQAIHTGKKPYKCNECGKVFTQNAHLANHRRIHTGEKPYRCTECGKAFRVRSSLTTHMAIHTGEKRYKCNECGKVFRQSSNLASHHRMHTGEKPYK

SEQ ID NO: 16000 - protein, 485 aa, Homo Sapiens
MATEPKKAAAQNSPEDEGLLIVKIEEEEFIHGQDTCLQRSELLKQELCRQLFRQFCYQDSPGPREALSRLRELCCQWLKPEIHTKEQILELLVLEQFLTILPGDLQAWVHEHYPESGEEAVTILEDLERGTDEAVLQVQAHEHGQEIFQKKVSPPGPALNVKLQPVETKAHFDSSEPQLLWDCDNESENSRSMPKLEIFEKIESQRIISGRISGYISEASGESQDICKSAGRVKRQWEKESGESQRLSSAQDEGFGKILTHKNTVRGEIISHDGCERRLNLNSNEFTHQKSCKHGTCDQSFKWNSDFINHQIIYAGEKNHQYGKSFKSPKLAKHAAVFSGDKTHQCNECGKAFRHSSKLARHQRIHTGERCYECNECGKSFAESSDLTRHRRIHTGERPFGCKECGRAFNLNSHLIRHQRIHTREKPYECSECGKTFRVSSHLIRHFRIHTGEKPYECSECGRAFSQSSNLSQHQRIHMRENLLM

SEQ ID NO: 16001 - protein, 603 aa, Homo Sapiens
MSPGLLTTRKEALMAFRDVAVAFTQKEWKLLSSAQRTLYREVMLENYSHLVSLGIAFSKPKLIEQLEQGDEPWREENEHLLDLCPEPRTEFQPSFPHLVAFSSSQLLRQYALSGHPTQIFPSSSAGGDFQLEAPRCSSEKGESGETEGPDSSLRKRPSRISRTFFSPHQGDPVEWVEGNREGGTDLRLAQRMSLGGSDTMLKGADTSESGAVIRGNYRLGLSKKSSLFSHQKHHVCPECGRGFCQRSDLIKHQRTHTGEKPYLCPECGRRFSQKASLSIHQRKHSGEKPYVCRECGRHFRYTSSLTNHKRIHSGERPFVCQECGRGFRQKIALLLHQRTHLEEKPFVCPECGRGFCQKASLLQHQSSHTGERPFLCLECGRSFRQQSLLLSHQVTHSGEKPYVCAECGHSFRQKVTLIRHQRTHTGEKPYLCPQCGRGFSQKVTLIGHQRTHTGEKPYLCPDCGRGFGQKVTLIRHQRTHTGEKPYLCPKCGRAFGFKSLLTRHQRTHSEEELYVDRVCGQGLGQKSHLISDQRTHSGEKPCICDECGRGFGFKSALIRHQRTHSGEKPYVCRECGRGFSQKSHLHRHRRTKSGHQLLPQEVF

SEQ ID NO: 16002 - protein, 662 aa, Homo Sapiens
MNLTEDYMVFEDVAIHFSQEEWGILNDVQRHLHSDVMLENFALLSSVGCWHGAKDEEAPSKQCVSVGVSQVTTLKPALSTQKAQPCETCSSLLKDILHLAEHDGTHPKRTAKLYLHQKEHLREKLTRSDEGRPSFVNDSVHLAKRNLTCMQGGKDFTGDSDLQQQALHSGWKPHRDTHGVEAFQSGQNNYSCTQCGKDFCHQHTLFEHQKIHTEERPYECSECGKLFRYNSDLIKHQRNHTGERPYKCSECGKAFSLKYNVVQHQKIHTGERPYECSECGKAFLRKSHLLQHQRIHTRPRPYVCSECGKAFLTQAHLVGHQKIHTGERPYGCNECGKYFMYSSALIRHQKVHTGERPFYCCECGKFFMDSCTLIIHQRVHTGEKPYECNECGKFFRYRSTLIRHQKVHTGEKPYECSECGKFFMDTSTLIIHQRVHTGEKPYECNKCGKFFRYCFTLNRHQRVHSGERPYECSECGKFFVDSCTLKSHQRVHTGERPFECSICGKSFRCRSTLDTHQRIHTGERPYECSECGKFFRHNSNHIRHRRNHFGERSFECTECGRVFSQNSHLIRHQKVHTRERTYKCSKCGKFFMDSSTLISHERVHTGEKPYECSECGKVFRYNSSLIKHRRIHTGERPYQCSECGRVFNQNSHLIQHQKVHTR

SEQ ID NO: 16003 - protein, 407 aa, Homo Sapiens
MAAKMEITLSSNTEASSKQERHIIAKLEEKRGPPLQKNCPDPELCRQSFRRFCYQEVSGPQEALSQLRQLCRQWLQPELHTKEQILELLVMEQFLTILPPEIQARVRHRCPMSSKEIVTLVEDFHRASKKPKQWVAVCMQGQKVLLEKTGSQLGEQELPDFQPQTPRRDLRESSPAEPSQAGAYDRLSPHHWEKSPLLQEPTPKLAGTEAPRMRSDNKENPQQEGAKGAKPCAVSAGRSKGNGLQNPEPRGANMSEPRLSRRQVSSPNAQKPFAHYQRHCRVEYISSPLKSHPLRELKKSKGGKRSLSNRLQHLGHQPTRSAKKPYKCDDCGKSFTWNSELKRHKRVHTGERPYTCGECGNCFGRQSTLKLHQRIHTGEKPYQCGQCGKSFRQSSNLHQHHRLHHGD

SEQ ID NO: 16004 - protein, 711 aa, Homo Sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQKDMVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVVGSGQLFSHSSSDACSKNIHTGETFCKGNQCRKVCGHKQSLKQHQIHTQKKPDGCSECGGSFTQKSHLFAQQRIHSVGNLHECGKCGKAFMPQLKLSVYLTDHTGDIPCICKECGKVFIQRSELLTHQKTHTRKKPYKCHDCGKAFFQMLSLFRHQRTHSREKLYECSECGKGFSQNSTLIIHQKIHTGERQYACSECGKAFTQKSTLSLHQRIHSGQKSYVCIECGQAFIQKAHLIVHQRSHTGEKPYQCHNCGKSFISKSQLDIHHRIHTGEKPYECSDCGKTFTQKSHLNIHQKIHTGERHHVCSECGKAFNQKSILSMHQRIHTGEKPYKCSECGKAFTSKSQFKEHQRIHTGEKPYVCTECGKAFNGRSNFHKHQITHTRERPFVCYKCGKAFVQKSELITHQRTHMGEKPYECLDCGKSFSKKPQLKVHQRIHTGERPYVCSECGKAFNNRSNFNKHQTTHTRDKSYKCSYSVKGFTKQ

SEQ ID NO: 16005 - protein, 549 aa, Homo Sapiens
MPVDLGQALGLLPSLAKAEDSQFSESDAALQEELSSPETARQLFRQFRYQVMSGPHETLKQLRKLCFQWLQPEVHTKEQILEILMLEQFLTILPGEIQMWVRKQCPGSGEEAVTLVESLKGDPQRLWQWISIQVLGQDILSEKMESPSCQVGEVEPHLEVVPQELGLENSSSGPGELLSHIVKEESDTEAELALAASQPARLEERLIRDQDLGASLLPAAPQEQWRQLDSTQKEQYWDLMLETYGKMVSGAGISHPKSDLTNSIEFGEELAGIYLHVNEKIPRPTCIGDRQENDKENLNLENHRDQELLHASCQASGEVPSQASLRGFFTEDEPGCFGEGENLPEALQNIQDEGTGEQLSPQERISEKQLGQHLPNPHSGEMSTMWLEEKRETSQKGQPRAPMAQKLPTCRECGKTFYRNSQLIFHQRTHTGETYFQCTICKKAFLRSSDFVKHQRTHTGEKPCKCDYCGKGFSDFSGLRHHEKIHTGEKPYKCPICEKSFIQRSNFNRHQRVHTGEKPYKCSHCGKSFSWSSSLDKHQRSHLGKKPFQ

SEQ ID NO: 16006 - protein, 692 aa, Homo Sapiens
MRACAGSTREAGSGAQDLSTLLCLEESMEEQDEKPPEPPKACAQDSFLPQEIIIKVEGEDTGSLTIPSQEGVNFKIVTVDFTREEQGTWNPAQRTLDRDVILENHRDLVSWDLATAVGKKDSTSKQRIFDEEPANGVKIERFTRDDPWLSSCEEVDDCKDQLEKQQEKQEILLQEVAFTQRKAVIHERVCKSDETGEKSGLNSSLFSSPVIPIRNHFHKHVSHAKKWHLNAAVNSHQKINENETLYENNECGKPPQSIHLIQFTRTQTKDKCYGFSDRIQSFCHGTPLHIHEKIHGGGKTFDFKECGQVLNPKISHNEQQRIPFEESQYKCSETSHSSSLTQNMRNNSEEKPFECNQCGKSFSWSSHLVAHQRTHTGEKPYECSECGKSFSRSSHLVSHQRTHTGEKPYRCNQCGKSFSQSYVLVVHQRTHTGEKPYECNQCGKSFRQSYKLIAHQRTHTGEKPYECNQCGKSFIQSYKLIAHQRIHTGEKPYECNQCGKSFSQSYKLVAHQRTHTGEKPFECNQCGKSFSWSSQLVAHQRTHTGEKPYECSECGKSFNRSSHLVMHQRIHTGEKPYECNQCGKSFSQSYVLVVHQRTHTGEKPYECSQCGKSFRQSSCLTQHQRTHTGEKPFECNQCGKTFSLSARLIVHQRTHTGEKPFTCIQCGKAFINSYKLIRHQATHTEEKLYECN

SEQ ID NO: 16007 - protein, 571 aa, Homo Sapiens
MPQVTFNDVAIDFTHEEWGWLSSAQRDLYKDVMVQNYENLVSVAGLSVTKPYVITLLEDGKEPWMMEKKLSKGMIPDWESRWENKELSTKKDNYDEDSPQTVIIEKVVKQSYEFSNSKKNLEYIEKLEGKHGSQVDHFRPAILTSRESPTADSVYKYNIFRSTFHSKSTLSEPQKISAEGNSHKYDILKKNLPKKSVIKNEKVNGGKKLLNSNKSGAAFSQGKSLTLPQTCNREKIYTCSECGKAFGKQSILNRHWRIHTGEKPYECRECGKTFSHGSSLTRHLISHSGEKPYKCIECGKAFSHVSSLTNHQSTHTGEKPYECMNCGKSFSRVSHLIEHLRIHTQEKLYECRICGKAFIHRSSLIHHQKIHTGEKPYECRECGKAFCCSSHLTRHQRIHTMEKQYECNKCLKVFSSLSFLVQHQSIHTEEKPFECQKCRKSFNQLESLNMHLRNHIRLKPYECSICGKAFSHRSSLLQHHRIHTGEKPYECIKCGKTFSCSSNLTVHQRIHTGEKPYKCNECGKAFSKGSNLTAHQRVHNGEKPNSVVSVEKPLDYMNHYTCEKSYRRETV

SEQ ID NO: 16008 - protein, 639 aa, Homo Sapiens
MTPASASGEDSGSFYSWQKAKREQGLVTFEDVAVDFTQEEWQYLNPPQRTLYRDVMLETYSNLVFVGQQVTKPNLILKLEVEECPAEGKIPFWNFPEVCQVDEQIERQHQDDQDKCLLMQVGFSDKKTIITKSARDCHEFGNILHLSTNLVASIQRPDKHESFGNNMVDNLDLFSRSSAENKYDNGCAKLFFHTEYEKTNPGMKPYGYKECGKGLRRKKGLSLHQRIKNGEKPFECTACRKTFSKKSHLIVHWRTHTGEKPFGCTECGKAFSQKSQLIIHLRTHTGERPFECPECGKAFREKSTVIIHYRTHTGEKPYECNECGKAFTQKSNLIVHQKTHTGEKTYECTKCGESFIQKLDLIIHHSTHTGKKPHECNECKKTFSDKSTLIIHQRTHTGEKPHKCTECGKSFNEKSTLIVHQRTHTGEKPYECDVCGKTFTQKSNLGVHQRTHSGEKPFECNECEKAFSQKSYLMLHQRGHTGEKPYECNECEKAFSQKSYLIIHQRTHTEEKPYKCNECGKAFREKSKLIIHQRIHTGEKPYECPVCWKAFSQKSQLIIHQRTHTGEKPYACTECGKAFREKSTFTVHQRTHTGEKPYKCTECGKAFTQKSNLIVHQRTHAGKKAHGRGHTRKSKFMAH

SEQ ID NO: 16009 - protein, 751 aa, Homo Sapiens
MEDLSSPDSTLLQGGHNLLSSASFQEAVTFKDVIVDFTQEEWKQLDPGQRDLFRDVTLENYTHLVSIGLQVSKPDVISQLEQGTEPWIMEPSIPVGTCADWETRLENSVSAPEPDISEEELSPEVIVEKHKRDDSWSSNLLESWEYEGSLERQQANQQTLPKEIKVTEKTIPSWEKGPVNNEFGKSVNVSSNLVTQEPSPEETSTKRSIKQNSNPVKKEKSCKCNECGKAFSYCSALIRHQRTHTGEKPYKCNECEKAFSRSENLINHQRIHTGDKPYKCDQCGKGFIEGPSLTQHQRIHTGEKPYKCDECGKAFSQRTHLVQHQRIHTGEKPYTCNECGKAFSQRGHFMEHQKIHTGEKPFKCDECDKTFTRSTHLTQHQKIHTGEKTYKCNECGKAFNGPSTFIRHHMIHTGEKPYECNECGKAFSQHSNLTQHQKTHTGEKPYDCAECGKSFSYWSSLAQHLKIHTGEKPYKCNECGKAFSYCSSLTQHRRIHTREKPFECSECGKAFSYLSNLNQHQKTHTQEKAYECKECGKAFIRSSSLAKHERIHTGEKPYQCHECGKTFSYGSSLIQHRKIHTGERPYKCNECGRAFNQNIHLTQHKRIHTGAKPYECAECGKAFRHCSSLAQHQKTHTEEKPYQCNKCEKTFSQSSHLTQHQRIHTGEKPYKCNECDKAFSRSTHLTEHQNTHTGEKPYNCNECRKTFSQSTYLIQHQRIHSGEKPFGCNDCGKSFRYRSALNKHQRLHPGI

SEQ ID NO: 16010 - protein, 626 aa, Homo Sapiens
MASPSPPPESKGLLTFEDVAVFFTQEEWDYLDPAQRSLYKDVMMENYGNLVSLDVLNRDKDEEPTVKQEIEEIEEEVEPQGVIVTRIKSEIDQDPMGRETFELVGRLDKQRGIFLWEIPRESLTQEQRMFRENTNIIRKRPNSEEKCHKCEECGKGFVRKAHFIQHQRVHTGEKPFQCNECGKSFSRSSFVIEHQRIHTGERPYECNYCGKTFSVSSTLIRHQRIHTGERPYQCNQCKQSFSQRRSLVKHQRIHTGEKPHKCSDCGKAFSWKSHLIEHQRTHTGEKPYHCTKCKKSFSRNSLLVEHQRIHTGERPHKCGECGKAFRLSTYLIQHQKIHTGEKPFLCIECGKSFSRSSFLIEHQRIHTGERPYQCKECGKSFSQLCNLTRHQRIHTGDKPHKCEECGKAFSRSSGLIQHQRIHTREKTYPYNETKESFDPNCSLVIQQEVYPKEKSYKCDECGKTFSVSAHLVQHQRIHTGEKPYLCTVCGKSFSRSSFLIEHQRIHTGERPYLCRQCGKSFSQLCNLIRHQGVHTGNKPHKCDECGKAFSRNSGLIQHQRIHTGEKPYKCEKCDKSFSQQRSLVNHQKIHAEVKTQETHECDACGEAFNCRISLIQHQKLHTAWMQ

SEQ ID NO: 16011 - protein, 458 aa, Homo Sapiens
MAAMPLKAQYQEMVTFEDVAVHFTKTEWTGLSPAQRALYRSVMLENFGNLTALGYPVPKPALISLLERGDMAWGLEAQDDPPAERTKNVCKDVETNIDSESTLIQGISEERDGMMSHGQLKSVPQRTDFPETRNVEKHQDIPTVKNIQGKVPRIPCARKPFICEECGKSFSYFSYYARHQRIHTGEKPFECSECGKAFNGNSSLIRHQRIHTGERPYQCEECGRAFNDNANLIRHQRIHSGDRPYYCTECGNSFTSSSEFVIHQRIHTGEKPYECNECGKAFVGNSPLLRHQKIHTGEKPYECNECGKSFGRTSHLSQHQRIHTGEKPYSCKVCGQAFNFHTKLTRHQRIHSEEKPFDCVDCGKAFSAQEQLKRHLRIHTQESSYVCDECGKALTSKRNLHQHQRIHTGEKPYECSKYEKAFGTSSQLGHLEHVYSGEKPVLDICRFGLPEFFTPFYW

SEQ ID NO: 16012 - protein, 629 aa, Homo Sapiens
MTLLTFRDVAIEFSLEEWKCLDLAQQNLYRDVMLENYRNLFSVGLTVCKPGLITCLEQRKEPWNVKRQEAADGHPEMGFHHATQACLELLGSSDLPASASQSAGITGVNHRAQPGLNVSVDKFTALCSPGVLQTVKWFLEFRCIFSLAMSSHFTQDLLPEQGIQDAFPKRILRGYGNCGLDNLYLRKDWESLDECKLQKDYNGLNQCSSTTHSKIFQYNKYVKIFDNFSNLHRRNISNTGEKPFKCQECGKSFQMLSFLTEHQKIHTGKKFQKCGECGKTFIQCSHFTEPENIDTGEKPYKCQECNNVIKTCSVLTKNRIYAGGEHYRCEEFGKVFNQCSHLTEHEHGTEEKPCKYEECSSVFISCSSLSNQQMILAGEKLSKCETWYKGFNHSPNPSKHQRNEIGGKPFKCEECDSIFKWFSDLTKHKRIHTGEKPYKCDECGKAYTQSSHLSEHRRIHTGEKPYQCEECGKVFRTCSSLSNHKRTHSEEKPYTCEECGNIFKQLSDLTKHKKTHTGEKPYKCDECGKNFTQSSNLIVHKRIHTGEKPYKCEECGRVFMWFSDITKHKKTHTGEKPYKCDECGKNFTQSSNLIVHKRIHTGEKPYKCEKCGKAFTQFSHLTVHESIHT

SEQ ID NO: 16013 - protein, 1029 aa, Homo Sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTSLEWETMTENEEVTSKPSSSQRADSHKGTSKRLQGSVPQVLDFEEECEWQVLASQWGNETDERADTVKKVSLCERDKKKRTPPEKQGQKWKELGDSLTFGSAISESLIGTEGKKFYKCDMCCKHFNKISHLINHRRIHTGEKPHKCKECGKGFIQRSSLLMHLRNHSGEKPYKCNECGKAFSQSAYLLNHQRIHTGEKPYKCKECGKGFYRHSGLIIHLRRHSGERPYKCNECGKVFSQNAYLIDHQRLHKGEEPYKCNKCQKAFILKKSLILHQRIHSGEKPYKCDECGKTFAQTTYLIDHQRLHSAENPYKCKECGKVFIRSKSLLLHQRVHTEKKTFGCKKCGKIFSSKSNFIDHKRMHSREKPYKCTECGKAFTQSAYLFDHQRLHNGEKPYECNECGKVFILKKSLILHQRFHTGENLYECKDCGKVFGSNRNLIDHERLHNGEKPYECRECGKTFIMSKSFMVHQKLHTQEKAYKCEDCGKAFSYNSSLLVHRRIHTGEKPFECSECGRAFSSNRNLIEHKRIHSGEKPYECDECGKCFILKKSLIGHQRIHTREKSYKCNDCGKVFSYRSNLIAHQRIHTGEKPYACSECGKGFTYNRNLIEHQRIHSGEKTYECHVCRKVLTSSRNLMVHQRIHTGEKPYKCNECGKDFSQNKNLVVHQRMHTGEKPYECDKCRKSFTSKRNLVGHQRIHTGEKPYGCNDCSKVFRQRKNLTVHQKIHTDEKPCECDVSEKEFSQTSNLHLQQKIHTIEEFSWLQNTNESKIEIQKI

SEQ ID NO: 16014 - protein, 426 aa, Homo Sapiens
MAAVSPTTRCQESVTFEDVAVVFTDEEWSRLVPIQRDLYKEVMLENYNSIVSLGLPVPQPDVIFQLKRGDKPWMVDLHGSEEREWPESVSLDWETKPEIHDASDKKSEGSLRECLGRQSPLCPKFEVHTPNGRMGTEKQSPSGETRKKSLSRDKGLRRRRSALSREILTKERHQECSDCGKTFFDHSSLTRHQRTHTGEKPYDCRECGKAFSHRSSLSRHLMSHTGESPYECSVCSKAFFDRSSLTVHQRIHTGEKPFQCNECGKAFFDRSSLTRHQRIHTGESPYECHQCGKAFSQKSILTRHQLIHTGRKPYECNECGKAFYGVSSLNRHQKAHAGDPRYQCNECGKAFFDRSSLTQHQKIHTGDKPYECSECGKAFSQRCRLTRHQRVHTGEKPFECTVCGKVFSSKSSVIQHQRRYAKQGID

SEQ ID NO: 16015 - protein, 532 aa, Homo Sapiens
MMFQDSVAFEDVAVSFTQEEWALLDPSQKNLYRDVMQETFKNLTSVGKTWKVQNIEDEYKNPRRNLSLMREKLCESKESHHCGESFNQIADDMLNRKTLPGITPCESSVCGEVGTGHSSLNTHIRADTGHKSSEYQEYGENPYRNKECKKAFSYLDSFQSHDKACTKEKPYDGKECTETFISHSCIQRHRVMHSGDGPYKCKFCGKAFYFLNLCLIHERIHTGVKPYKCKQCGKAFTRSTTLPVHERTHTGVNADECKECGNAFSFPSEIRRHKRSHTGEKPYECKQCGKVFISFSSIQYHKMTHTGEKPYECKQCGKAFRCGSHLQKHGRTHTGEKPYECRQCGKAFRCTSDLQRHEKTHTEDKPYGCKQCGKGFRCASQLQIHERTHSGEKPHECKECGKVFKYFSSLRIHERTHTGEKPHECKQCGKAFRYFSSLHIHERTHTGDKPYECKVCGKAFTCSSSIRYHERTHTGEKPYECKHCGKAFISNYIRYHERTHTGEKPYQCKQCGKAFIRASSCREHERTHTINR

SEQ ID NO: 16016 - protein, 390 aa, Homo Sapiens; identical to SEQ ID NO: 15978

SEQ ID NO: 16017 - protein, 395 aa, Homo Sapiens
MMAAKVVPMPPKPKQSFILRVPPDSKLGQDLLRDATNGPKTIHQLVLEHFLTFLPKPSLVQPSQKVKETLVIMKDVSSSLQNRVHPRPLVKLLPKGVQKEQETVSLYLKANPEELVVFEDLNVFHCQEECVSLDPTQQLTSEKEDDSSVGEMMLLAVNGSNPEGEDPEREPVENEDYREKSSDDDEMDSSLVSQQPPDNQEKERLNTSIPQKRKMRNLLVTIENDTPLEELSKYVDISIIALTRNRRTRRWYTCPLCGKQFNESSYLISHQRTHTGEKPYDCNHCGKSFNHKTNLNKHERIHTGEKPYSCSQCGKNFRQNSHRSRHEGIHIREKIFKCPECGKTFPKNEEFVLHLQSHEAERPYGCKKCGRRFGRLSNCTRHEKTHSACKTRKQK

SEQ ID NO: 16018 - protein, 648 aa, Homo Sapiens
MATAVEPEDQDLWEEEGILMVKLEDDFTCRPESVLQRDDPVLETSHQNFRRFRYQEAASPREALIRLRELCHQWLRPERRTKEQILELLVLEQFLTVLPGELQSWVRGQRPESGEEAVTLVEGLQKQPRRPRRWVTVHVHGQEVLSEETVHLGVEPESPNELQDPVQSSTPEQSPEETTQSPDLGAPAEQRPHQEEELQTLQESEVPVPEDPDLPAERSSGDSEMVALLTALSQGLVTFKDVAVCFSQDQWSDLDPTQKEFYGEYVLEEDCGIVVSLSFPIPRPDEISQVREEEPWVPDIQEPQETQEPEILSFTYTGDRSKDEEECLEQEDLSLEDIHRPVLGEPEIHQTPDWEIVFEDNPGRLNERRFGTNISQVNSFVNLRETTPVHPLLGRHHDCSVCGKSFTCNSHLVRHLRTHTGEKPYKCMECGKSYTRSSHLARHQKVHKMNAPYKYPLNRKNLEETSPVTQAERTPSVEKPYRCDDCGKHFRWTSDLVRHQRTHTGEKPFFCTICGKSFSQKSVLTTHQRIHLGGKPYLCGECGEDFSEHRRYLAHRKTHAAEELYLCSECGRCFTHSAAFAKHLRGHASVRPCRCNECGKSFSRRDHLVRHQRTHTGEKPFTCPTCGKSFSRGYHLIRHQRTHSEKTS

SEQ ID NO: 16019 - protein, 554 aa, Homo Sapiens
MSADGGGIQDTQDKETPPEVPDRGHPHQEMPSKLGEAVPSGDTQESLHIKMEPEEPHSEGASQEDGAQGAWGWAPLSHGSKEKALFLPGGALPSPRIPVLSREGRTRDRQMAAALLTAWSQMPVTFEDVALYLSREEWGRLDHTQQNFYRDVLQKKNGLSLGFPFSRPFWAPQAHGKGEASGSSRQAGDEKEWRGACTGAVEVGQRVQTSSVAALGNVKPFRTRAGRVQWGVPQCAQEAACGRSSGPAKDSGQPAEPDRTPDAAPPDPSPTEPQEYRVPEKPNEEEKGAPESGEEGLAPDSEVGRKSYRCEQCGKGFSWHSHLVTHRRTHTGEKPYACTDCGKRFGRSSHLIQHQIIHTGEKPYTCPACRKSFSHHSTLIQHQRIHTGEKPYVCDRCAKRFTRRSDLVTHQGTHTGAKPHKCPICAKCFTQSSALVTHQRTHTGVKPYPCPECGKCFSQRSNLIAHNRTHTGEKPYHCLDCGKSFSHSSHLTAHQRTHRGVRPYACPLCGKSFSRRSNLHRHEKIHTTGPKALAMLMLGAAAAGALATPPPAPT

SEQ ID NO: 16020 - protein, 478 aa, Homo Sapiens; identical to SEQ ID NO: 14396

SEQ ID NO: 16021 - protein, 1280 aa, Homo Sapiens
MGSLTFRDVAIEFSLEEWQCLDTAQQNLYRNVMLENYRNLVFLGIAAFKPDLIIFLEEGKESWNMKRHEMVEESPVICSHFAQDLWPEQGIEDSFQKVILRRYEKCGHENLHLKIGYTNVDECKVHKEGYNKLNQSLTTTQSKVFQRGKYANVFHKCSNSNRHKIRHTGKKHLQCKEYVRSFCMLSHLSQHKRIYTRENSYKCEEGGKAFNWSSTLTYYKSAHTGEKPYRCKECGKAFSKFSILTKHKVIHTGEKSYKCEECGKAFNQSAILTKHKIIHTGEKPNKCEECGKAFSKVSTLTTHKAIHAGEKPYKCKECGKAFSKVSTLITHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFNWSSNLMEHKKIHTGETPYKCEECGKGFSMFSILTKHKVIHNGEKPYKCEECDKATHAGEKPYKCEECGKAFNWSSNLMEHKRIHTGEKPYKCEECGKSFSTFSILTKHKVIHTGEKPYKCEECGKAYKWSSTLSYHKKIHTVEKPYKCEECGKAFNQSAILIKHKRIHTGEKPYKCEECGKTFSKVSTLTTHKAIHAGEKPYKCKECGKTFIKVSTLTTHKAIHAGEKPYKCKECGKAFSKFSILTKHKVIHTGEKPYKCEECGKAFNWSSNLMEHKRIHTGEKPYKCEECGKSFSTFSVLTKHKVIHTGEKPYKCEECGKAYKWSSTLSYHKKIHTVEKPYKCEECGKAFNRSAILIKHKRIHTDEKPYKCEECGKTFSKVSTLTTHKAIHAGEKPYKCKECGKAFSKFSILTKHKVIHTGEKPYKCEECGKAYKWPSTLSYHKKIHTGEKPYKCEECGKGFSMFSILTKHEVIHTGEKPYKCEECGKAFSWLSVFSKHKKTHAGEKFYKCEACGKAYKSSSTLSYHKKIHTEEKPYKYEECGKGFSTFSILTKHKVIHTGEKPYKCEECGKAFNWSSNLMEHKKIHTGETPYKCEECDKAFSWPSSLTEHKATHAGEKPYKCEECGKAFSWPSRLTEHKATHAGEEPYKCEECGKAFNWSSNLMEHKRIHTGEKPYKCEECGKSFSTFSILTKHKVIHTGEKPYKCEECGKAYKWSSTLSYHKKIHTVEKPYKCEECGKGFVMFSILAKHKVIHTGEKLYKCEECGKAYKWPSTLRYHKKIHTGEKPYKCEECGKAFSTFSILTKHKVIHTGEKPYKCEECGKAFSWLSVFSKHKKIHTGEKL

SEQ ID NO: 16022 - protein, 564 aa, Homo Sapiens
MLGFPPGRPQLPVQLRPQTRMATALRDPASGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 16023 - protein, 495 aa, Homo Sapiens
MAESAPARHRRKRRSTPLTSSTLPSQATEKSSYFQTTEISLWTVVAAIQAVEKKMESQAARLQSLEGRTGTAEKKLADCEKMAVEFGNQLEGKWAVLGTLLQEYGLLQRRLENVENLLRNRNFWILRLPPGSKGEAPKVSRSLENDGVCFTEQEWENLEDWQKELYRNVMESNYETLVSLKVLGQTEGEAELGTEMLGDLEEEGPGGAHPAGGVMIKQELQYTQEGPADLPGEFSCIAEEQAFLSPEQTELWGGQGSSVLLETGPGDSTLEEPVGSRVPSSSRTVGCPKQKSHRQVQLDQECGQGLKLKKDTSRPYECSECEITFRYKQQLATHLRSHSGWGSCTPEEPEESLRPRPRLKPQTKKAKLHQCDVCLRSFSCKVSLVTHQRCHLQEGPSAGQHVQERFSPNSLVALPGHIPWRKSRSSLICGYCGKSFSHPSDLVRHQRIHTGERPYSCTECEKSFVQKQHLLQHQKIHQRERGGLALEPGRPNGLL

SEQ ID NO: 16024 - protein, 459 aa, Homo Sapiens
MAAPLEAQDQAPGEGEGLLIVKVEDSSWEQESAQHEDGRDSEACRQRFRQFCYGDVHGPHEAFSQLWELCCRWLRPELRTKEQILELLVLEQFLTVLPGEIQGWVREQHPGSGEEAVALVEDLQKQPVKAWRQDVPSEEAEPEAAGRGSQATGPPPTVGARRRPSVPQEQHSHSAQPPALLKEGRPGETTDTCFVSGVHGPVALGDIPFYFSREEWGTLDPAQRDLFWDIKRENSRNTTLGFGLKGQSEKSLLQEMVPVVPGQTGSDVTVSWSPEEAEAWESENRPRAALGPVVGARRGRPPTRRRQFRDLAAEKPHSCGQCGKRFRWGSDLARHQRTHTGEKPHKCPECDKSFRSSSDLVRHQGVHTGEKPFSCSECGKSFSRSAYLADHQRIHTGEKPFGCSDCGKSFSLRSYLLDHRRVHTGERPFGCGECDKSFKQRAHLIAHQSLHAKMAQPVG

SEQ ID NO: 16025 - protein, 606 aa, Homo Sapiens
MAVTFEDVTIIFTWEEWKFLDSSQKRLYREVMWENYTNVMSVENWNESYKSQEEKFRYLEYENFSYWQGWWNAGAQMYENQNYGETVQGTDSKDLTQQDRSQCQEWLILSTQVPGYGNYELTFESKSLRNLKYKNFMPWQSLETKTTQDYGREIYMSGSHGFQGGRYRLGISRKNLSMEKEQKLIVQHSYIPVEEALPQYVGVICQEDLLRDSMEEKYCGCNKCKGIYYWNSRCVFHKRNQPGENLCQCSICKACFSQRSDLYRHPRNHIGKKLYGCDEVDGNFHQSSGVHFHQRVHIGEVPYSCNACGKSFSQISSLHNHQRVHTEEKFYKIECDKDLSRNSLLHIHQRLHIGEKPFKCNQCGKSFNRSSVLHVHQRVHTGEKPYKCDECGKGFSQSSNLRIHQLVHTGEKSYKCEDCGKGFTQRSNLQIHQRVHTGEKPYKCDDCGKDFSHSSDLRIHQRVHTGEKPYTCPECGKGFSKSSKLHTHQRVHTGEKPYKCEECGKGFSQRSHLLIHQRVHTGEKPYKCHDCGKGFSHSSNLHIHQRVHTGEKPYQCAKCGKGFSHSSALRIHQRVHAGEKPYKCREYYKGFDHNSHLHNNHRRGNL

SEQ ID NO: 16026 - protein, 517 aa, Homo Sapiens
MQPLSKLMAISKPRNLSLREQREVLRADMSWQQETNPVVETHDSEASRQKFRHFQYLKVSGPHEALSQLWELCLQWLRPEIHTKKQIIELLVLEQFLAILPEEVRTWVNLQHPNNSKDMVTLIEDVIEMLEDEDMPCKDSALQMGSIKEKMKAGSRTGKPQEPVTFKDVVVEFSKEEWGQLDSAVKNLYRNVMLENFRNLNSLRKAHLLSKPFESLKLESKKKRWIMEKEIPRKTIFDMKSISGEESSHGVIMTRLTESGHPSSDAWKGENWLYRNQKKWDINLPQEAFIPETIYTEEEDFECSENKKSFDINSVSSICAIQVGIPSRKGSPKCDKFKTYFKFNLDSVGKQHSEYEYGNDLSLSTDIRHQKSHTTMNSYECYQCGKAFCRSSSLIRHQIIHTGEKPYKCSECGRFFNRRTNLTKHQKLHAEAKACTSNKCGKAFSKSEDSNNPTLHFGNNFYQCVNCGKSFNRSSSLIRHQMIHTGEKPFKCKECSKAFNRSSNLVKHQKLHTRDKS

SEQ ID NO: 16027 - protein, 1048 aa, Homo Sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQGGMPSSREDFLQLFNLRPKSHPETGKKPVRCIPQLDPFTTFQAWQLATKGKVAICQEVKESGQEGSTDNDDSSSEKELGETNKGSCAGLSQEKEKCKHSHGEAPSVDADPKLPSSKEKPTHCSECGKAFRTYHQLVLHSRVHKKDRRAGAESPTMSVDGRQPGTCSPDLAAPLDENGAVDRGEGGSEDGSEDGLPEGIHLDKNDDGGKIKHLTSSRECSYCGKFFRSNYYLNIHLRTHTGEKPYKCEFCEYAAAQKTSLRYHLERHHKEKQTDVAAEVKNDGKNQDTEDALLTADSAQTKNLKRFFDGAKDVTGSPPAKQLKEMPSVFQNVLGSAVLSPAHKDTQDFHKNAADDSADKVNKNPTPAYLDLLKKRSAVETQANNLICRTKADVTPPPDGSTTHNLEVSPKEKQTETAADCRYRPSVDCHEKPLNLSVGALHNCPAISLSKSLIPSITCPFCTFKTFYPEVLMMHQRLEHKYNPDVHKNCRNKSLLRSRRTGCPPALLGKDVPPLSSFCKPKPKSAFPAQSKSLPSAKGKQSPPGPGKAPLTSGIDSSTLAPSNLKSHRPQQNVGVQGAATRQQQSEMFPKTSVSPAPDKTKRPETKLKPLPVAPSQPTLGSSNINGSIDYPAKNDSPWAPPGRDYFCNRSASNTAAEFGEPLPKRLKSSVVALDVDQPGANYRRGYDLPKYHMVRGITSLLPQDCVYPSQALPPKPRFLSSSEVDSPNVLTVQKPYGGSGPLYTCVPAGSPASSSTLEGKRPVSYQHLSNSMAQKRNYENFIGNAHYRPNDKKT

SEQ ID NO: 16028 - protein, 722 aa, Homo Sapiens
MEGSRPRAPSGHLAPSPPAFDGELDLQRYSNGPAVSAGSLGMGAVSWSESRAGERRFPCPVCGKRFRFNSILALHLRAHPGAQAFQCPHCGHRAAQRALLRSHLRTHQPERPRSPAARLLLELEERALLREARLGRARSSGGMQATPATEGLARPQAPSSSAFRCPYCKGKFRTSAERERHLHILHRPWKCGLCSFGSSQEEELLHHSLTAHGAPERPLAATSAAPPPQPQPQPPPQPEPRSVPQPEPEPEPEREATPTPAPAAPEEPPAPPEFRCQVCGQSFTQSWFLKGHMRKHKASFDHACPVCGRCFKEPWFLKNHMKVHASKLGPLRAPGPASGPARAPQPPDLGLLAYEPLGPALLLAPAPTPAERREPPSLLGYLSLRAGEGRPNGEGAEPGPGRSFGGFRPLSSALPARARRHRAEEPEEEEEVVEAEEETWARGRSLGSLASLHPRPGEGPGHSASAAGAQARSTATQEENGLLVGGTRPEGGRGATGKDCPFCGKSFRSAHHLKVHLRVHTGERPYKCPHCDYAGTQSGSLKYHLQRHHREQRSGAGPGPPPEPPPPSQRGSAPQSGAKPSPQPATWVEGASSPRPPSSGAGPGSRRKPASPGRTLRNGRGGEAEPLDLSLRAGPGGEAGPGGALHRCLFCPFATGAPELMALHLQVHHSRRARGRRPPQADASPPYARVPSGETPPSPSQEGEEGSGLSRPGEAGLGGQER

SEQ ID NO: 16029 - protein, 224 aa, Homo Sapiens
MRLAKPKAGISRSSSQGKAYENKRKTGRQRQKWGMTIRFDSSFSRLRRSLDDKPYKCTECEKSFSQSSTLFQHQKIHTGKKSHKCADCGKSFFQSSNLIQHRRIHTGEKPYKCDECGESFKQSSNLIQHQRIHTGEKPYQCDECGRCFSQSSHLIQHQRTHTGEKPYQCSECGKCFSQSSHLRQHMKVHKEEKPRKTRGKNIRVKTHLPSWKAGTGRKSVAGLR

SEQ ID NO: 16030 - protein, 617 aa, Homo Sapiens
MISPSLELLHSGLCKFPEVEGKMTTFKEAVTFKDVAVVFTEEELGLLDPAQRKLYRDVMLENFRNLLSVGNQPFHQDTFHFLGKEKFWKMKTTSQREGNSGGKIQIEMETVPEAGPHEEWSCQQIWEQIASDLTRSQNSIRNSSQFFKEGDVPCQIEARLSISHVQQKPYRCNECKQSFSDVSVFDLHQQSHSGEKSHTCGECGKSFCYSPALHIHQRVHMGEKCYKCDVCGKEFNQSSHLQTHQRVHTGEKPFKCGQCGKGFHSRSALNVHCKLHTGEKPYNCEECGKAFIHDSQLQEHQRIHTGEKPFKCDICGKSFRVRSRLNRHSMVHTGEKPFRCDTCGKNFRQRSALNSHSMVHIEEKPYKCEQCGKGFICRRDFCKHQMVHTGEKPYNCKECGKTFRWSSCLLNHQQVHSGQKSFKCEECGKGFYTNSRRSSHQRSHNGEKPYNCEECGKDYKRRLDLEFHQRVHTGERPYNCKECGKSFGWASCLLKHQRLHSGEKPFKCEECGKRFTQSSQLHSHQTCHTGEKLYKCEQCEKGYNSKFNLDMHQRVHGGERPYNCKECGKSFGWASCLLKHQRLHSGEKPLKSGVWEEIYSEFTASFTSVSLCGRKAI

SEQ ID NO: 16031 - protein, 482 aa, Homo Sapiens
MTMSKEAVTFKDVAVVFTEEELGLLDLAQRKLYRDVMLENFRNLLSVGHQPFHRDTFHFLREEKFWMMDIATQREGNSGGKIQPEMKTFPEAGPHEGWSCQQIWEEIASDLTRPQDSTIKSSQFFEQGDAHSQVEEGLSIMHTGQKPSNCGKCKQSFSDMSIFDLPQQIRSAEKSHSCDECGKSFCYISALHIHQRVHLGEKLFKCDVCGKEFSQSLHLQTHQRVHTGEKPFKCEQCGRGFRCRSALTVHCKLHMGEKHYNCEACGRAFIHDFQLQKHQRIHTGEKPFKCEICSVSFRLRSSLNRHCVVHTGKKPNSTGEYGKGFIRRLDLCKHQTIHTGEKPYNCKECGKSFRRSSYLLIHQRVHTGEKPYKCDKCGKSYITKSGLDLHHRAHTGERPYNCDDCGKSFRQASSILNHKRLHCRKKPFKCEDCGKKLVYRSYRKDQQKNHSGENPSKCEDCGKRYKRRLNLDIILSLFLNDT

SEQ ID NO: 16032 - protein, 707 aa, Homo Sapiens
MTTFKEAMTFKDVAVVFTEEELGLLDLAQRKLYRDVMLENFRNLLSVGHQAFHRDTFHFLREEKIWMMKTAIQREGNSGDKIQTEMETVSEAGTHQEWSFQQIWEKIASDLTRSQDLMINSSQFSKEGDFPCQTEAGLSVIHTRQKSSQGNGYKPSFSDVSHFDFHQQLHSGEKSHTCDECGKNFCYISALRIHQRVHMGEKCYKCDVCGKEFSQSSHLQTHQRVHTGEKPFKCVECGKGFSRRSALNVHHKLHTGEKPYNCEECGKAFIHDSQLQEHQRIHTGEKPFKCDICGKSFCGRSRLNRHSMVHTAEKPFRCDTCDKSFRQRSALNSHRMIHTGEKPYKCEECGKGFICRRDLYTHHMVHTGEKPYNCKECGKSFRWASCLLKHQRVHSGEKPFKCEECGKGFYTNSQCYSHQRSHSGEKPYKCVECGKGYKRRLDLDFHQRVHTGEKLYNCKECGKSFSRAPCLLKHERLHSGEKPFQCEECGKRFTQNSHLHSHQRVHTGEKPYKCEKCGKGYNSKFNLDMHQKVHTGERPYNCKECGKSFGWASCLLKHQRLHSGEKPFKCEECGKRFTQNSQLHSHQRVHTGEKPYKCDECGKGFSWSSTRLTHQRRHSRETPLKCEQHGKNIVQNSFSKVQEKVHSVEKPYKCEDCGKGYNRRLNLDMHQRVHMGEKTWKCRECDMCFSQASSLRLHQNVHVGEKP

SEQ ID NO: 16033 - protein, 543 aa, Homo Sapiens
MAAAKAEMQLMSPLQISDPFGSFPHSPTMDNYPKLEEMMLLSNGAPQFLGAAGAPEGSGSNSSSSSSGGGGGGGGGSNSSSSSSTFNPQADTGEQPYEHLTAESFPDISLNNEKVLVETSYPSQTTRLPPITYTGRFSLEPAPNSGNTLWPEPLFSLVSGLVSMTNPPASSSSAPSPAASSASASQSPPLSCAVPSNDSSPIYSAAPTFPTPNTDIFPEPQSQAFPGSAGTALQYPPPAYPAAKGGFQVPMIPDYLFPQQQGDLGLGTPDQKPFQGLESRTQQPSLTPLSTIKAFATQSGSQDLKALNTSYQSQLIKPSRMRKYPNRPSKTPPHERPYACPVESCDRRFSRSDELTRHIRIHTGQKPFQCRICMRNFSRSDHLTTHIRTHTGEKPFACDICGRKFARSDERKRHTKIHLRQKDKKADKSVVASSATSSLSSYPSPVATSYPSPVTTSYPSPATTSYPSPVPTSFSSPGSSTYPSPVHSGFPSPSVATTYSSVPPAFPAQVSSFPSSAVTNSFSASTGLSDMTATFSPRTIEIC

SEQ ID NO: 16034 - protein, 706 aa, Homo Sapiens; identical to SEQ ID NO: 14917

SEQ ID NO: 16035 - protein, 803 aa, Homo Sapiens
MNMFKEAVTFKDVAVAFTEEELGLLGPAQRKLYRDVMVENFRNLLSVGHPPFKQDVSPIERNEQLWIMTTATRRQGNLGEKNQSKLITVQDRESEEELSCWQIWQQIANDLTRCQDSMINNSQCHKQGDFPYQVGTELSIQISEDENYIVNKADGPNNTGNPEFPILRTQDSWRKTFLTESQRLNRDQQISIKNKLCQCKKGVDPIGWISHHDGHRVHKSEKSYRPNDYEKDNMKILTFDHNSMIHTGQKSYQCNECKKPFSDLSSFDLHQQLQSGEKSLTCVERGKGFCYSPVLPVHQKVHVGEKLKCDECGKEFSQGAHLQTHQKVHVIEKPYKCKQCGKGFSRRSALNVHCKVHTAEKPYNCEECGRAFSQASHLQDHQRLHTGEKPFKCDACGKSFSRNSHLQSHQRVHTGEKPYKCEECGKGFICSSNLYIHQRVHTGEKPYKCEECGKGFSRPSSLQAHQGVHTGEKSYICTVCGKGFTLSSNLQAHQRVHTGEKPYKCNECGKSFRRNSHYQVHLVVHTGEKPYKCEICGKGFSQSSYLQIHQKAHSIEKPFKCEECGQGFNQSSRLQIHQLIHTGEKPYKCEECGKGFSRRADLKIHCRIHTGEKPYNCEECGKVFRQASNLLAHQRVHSGEKPFKCEECGKSFGRSAHLQAHQKVHTGDKPYKCDECGKGFKWSLNLDMHQRVHTGEKPYKCGECGKYFSQASSLQLHQSVHTGEKPYKCDVCGKVFSRSSQLQSHQRVHTGEKPYKCEICGKSFSWRSNLTVHHRIHVGDKSYKSNRGGKNIRESTQEKKSIK

SEQ ID NO: 16036 - protein, 799 aa, Homo Sapiens
MPSQNYDLPQKKQEKMTKFQEAVTFKDVAVVFSREELRLLDLTQRKLYRDVMVENFKNLVAVGHLPFQPDMVSQLEAEEKLWMMETETQRSSKHQNKMETLQKFALKYLSNQELSCWQIWKQVASELTRCLQGKSSQLLQGDSIQVSENENNIMNPKGDSSIYIENQEFPFWRTQHSCGNTYLSESQIQSRGKQIDVKNNLQIHEDFMKKSPFHEHIKTDTEPKPCKGNEYGKIISDGSNQKLPLGEKPHPCGECGRGFSYSPRLPLHPNVHTGEKCFSQSSHLRTHQRIHPGEKLNRCHESGDCFNKSSFHSYQSNHTGEKSYRCDSCGKGFSSSTGLIIHYRTHTGEKPYKCEECGKCFSQSSNFQCHQRVHTEEKPYKCEECGKGFGWSVNLRVHQRVHRGEKPYKCEECGKGFTQAAHFHIHQRVHTGEKPYKCDVCGKGFSHNSPLICHRRVHTGEKPYKCEACGKGFTRNTDLHIHFRVHTGEKPYKCKECGKGFSQASNLQVHQNVHTGEKRFKCETCGKGFSQSSKLQTHQRVHTGEKPYRCDVCGKDFSYSSNLKLHQVIHTGEKPYKCEECGKGFSWRSNLHAHQRVHSGEKPYKCEQCDKSFSQAIDFRVHQRVHTGEKPYKCGVCGKGFSQSSGLQSHQRVHTGEKPYKCDVCGKGFRYSSQFIYHQRGHTGEKPYKCEECGKGFGRSLNLRHHQRVHTGEKPHICEECGKAFSLPSNLRVHLGVHTREKLFKCEECGKGFSQSARLEAHQRVHTGEKPYKCDICDKDFRHRSRLTYHQKVHTGKKL

SEQ ID NO: 16037 - protein, 825 aa, Homo Sapiens
METLTSRHEKRALHSQASAISQDREEKIMSQEPLSFKDVAVVFTEEELELLDSTQRQLYQDVMQENFRNLLSVGERNPLGDKNGKDTEYIQDEELRFFSHKELSSCKIWEEVAGELPGSQDCRVNLQGKDFQFSEDAAPHQGWEGASTPCFPIENSLDSLQGDGLIGLENQQFPAWRAIRPIPIQGSWAKAFVNQLGDVQERCKNLDTEDTVYKCNWDDDSFCWISCHVDHRFPEIDKPCGCNKCRKDCIKNSVLHRINPGENGLKSNEYRNGFRDDADLPPHPRVPLKEKLCQYDEFSEGLRHSAHLNRHQRVPTGEKSVKSLERGRGVRQNTHIRNHPRAPVGDMPYRCDVCGKGFRYKSVLLIHQGVHTGRRPYKCEECGKAFGRSSNLLVHQRVHTGEKPYKCSECGKGFSYSSVLQVHQRLHTGEKPYTCSECGKGFCAKSALHKHQHIHPGEKPYSCGECGKGFSCSSHLSSHQKTHTGERPYQCDKCGKGFSHNSYLQAHQRVHMGQHLYKCNVCGKSFSYSSGLLMHQRLHTGEKPYKCECGKSFGRSSDLHIHQRVHTGEKPYKCSECGKGFRRNSDLHSHQRVHTGERPYVCDVCGKGFIYSSDLLIHQRVHTGEKPYKCAECGKGFSYSSGLLIHQRVHTGEKPYRCQECGKGFRCTSSLHKHQRVHTGKKPYTCDQCGKGFSYGSNLRTHQRLHTGEKPYTCCECGKGFRYGSGLLSHKRVHTGEKPYRCHVCGKGYSQSSHLQGHQRVHTGEKPYKCEECGKGFGRNSCLHVHQRVHTGEKPYTCGVCGKGFSYTSGLRNHQRVHLGENPYK

SEQ ID NO: 16038 - protein, 643 aa, Homo Sapiens
MLENYGNVASLGFPLLKPAVISQLEGGSELGGSSPLAAGTGLQGLQTDIQTDNDLTKEMYEGKENVSFELQRDFSQETDFSEASLLEKQQEVHSAGNIKKEKSNTIDGTVKDETSPVEECFFSQSSNSYQCHTITGEQPSGCTGLGKSISFDTKLVKHEIINSEERPFKCEELVEPFRCDSQLIQHQENNTEEKPYQCSECGKAFSINEKLIWHQRLHSGEKPFKCVECGKSFSYSSHYITHQTIHSGEKPYQCKMCGKAFSVNGSLSRHQRIHTGEKPYQCKECGNGFSCSSAYITHQRVHTGEKPYECNDCGKAFNVNAKLIQHQRIHTGEKPYECNECGKGFRCSSQLRQHQSIHTGEKPYQCKECGKGFNNNTKLIQHQRIHTGEKPYECTECGKAFSVKGKLIQHQRIHTGEKPYECNECGKAFRCNSQFRQHLRIHTGEKPYECNECGKAFSVNGKLMRHQRIHTGEKPFECNECGRCFTSKRNLLDHHRIHTGEKPYQCKECGKAFSINAKLTRHQRIHTGEKPFKCMECEKAFSCSSNYIVHQRIHTGEKPFQCKECGKAFHVNAHLIRHQRSHTGEKPFRCVECGKGFSFSSDYIIHQTVHTWKKPYMCSVCGKAFRFSFQLSQHQSVHSEGKS

SEQ ID NO: 16039 - protein, 230 aa, Homo Sapiens
MGQQISDQTQLVINKLPEKVAKHVTLVRESGSLTYEEFLGRVAELNDVTAKVASGQEKHLLFEVQPGSDSSAFWKVVVRVVCTKINKSSGIVEASRIMNLYQFIQLYKDITSQAAGVLAQSSTSEEPDENSSSVTSCQASLWMGRVKQLTDEEECCICMDGRADLILPCAHSFCQKCIDKWSDRHRNCPICRLQMTGANESWVVSDAPTEDDMANYILNMADEAGQPHRP

SEQ ID NO: 16040 - protein, 474 aa, Homo Sapiens
MTTFKEAVTFKDVAVFFTEEELGLLDPAQRKLYQDVMLENFTNLLSVGHQPFHPFHFLREEKFWMMETATQREGNSGGKTIAEAGPHEDCPCQQIWEQTASDLTQSQDSIINNSHFFEQGDVPSQVEAGLSIIHTGQKPSQNGKCKQSFSDVAIFDPPQQFHSGEKSHTCNECGKSFCYISALRIHQRVHLREKLSKCDMRGKEFSQSSCLQTRERVHTGEKPFKCEQCGKGFRCRAILQVHCKLHTGEKPYICEKCGRAFIHDFQLQKHQIIHTGEKPFKCEICGKSFCLRSSLNRHCMVHTAEKLYKSEECGKGFTDSLDLHKHQIIHTGQKPYNCKECGKSFRWSSYLLIHQRIHSGEKPYRCEECGKGYISKSGLNLHQRVHTGERPYNCKECGKSFSRASSILNHKKLHCRKKPFKCEDCGKRLVHRSFCKDQQGDHNGENSSKCEDCGKRYKRRLNLDIILSLFLNDM

SEQ ID NO: 16041 - protein, 417 aa, Homo Sapiens
MAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSEQVYLHFLSVVTEDGPEPKDKGSLPQPPITEVESQVFSEKLATDTSTFEATSEGTLELQQRNPKAERLRWSPAQEESFRQMVVIHKEIPTGKKDHECSECGKTFIYNSHLVVHQRVHSGEKPYKCSDCGKTFKQSSNLGQHQRIHTGEKPFECNECGKAFRWGAHLVQHQRIHSGEKPYECNECGKAFSQSSYLSQHRRIHSGEKPFICKECGKAYGWCSELIRHRRVHARKEPSH

SEQ ID NO: 16042 - protein, 670 aa, Homo Sapiens
MTKFQEMVTFKDVAVVFTREELGLLDLAQRKLYQDVMLENFRNLLSVGYQPFKLDVILQLGKEDKLRMMETEIQGDGCSGHKNQNEIDTLQEVRLRFLSYEDLICWQIWEQFTSKLTSNQDLIINLQGKRSKLLKQGDSPCQVWTGESSQVSEDENYVIKLQGESSNSIKNQELPLRTTWDFWRKMYLREPQNYQSRCQQIDVKNKLCKCDHCVRQRIAHQHDDHGVHKREKAFSHNNCGKDCVKESSQHSIIQSGEQTSDENGKGLSVGSNLELHQQLHLRDKPHVNVEYGKGIGYSSGLPRHQCFHIGEKCYRNGDSGEGFSQGSHLQPHQRVSTGENLYRCQVYARSSNQNSCLPSHELTHPGEKLCTCGRCGKGFHHSLDFDIHCVDSAGERACKCDVYDKGFSQTSQLQAHQRGHSRDKTYKWEVSDRIFNRNSGLHQRVHTGEKPYKCEVCDKGFSKASNLQAHQRIHTGEKPYKCDVCDKNFSRNSHLQAHQRVHTGEKPYKCDTCGKDFSQISHLQAHQRVHKGEKPYKCETCGKGFSQSSHLQDHQQVHTGENPYKCDVCGKGFSWSSHLQAHQRVHTGEKPYKCEECRKGFIWNSYLHVHQRIHTGEKPYKCGMCGKSFSQTSHLQAHQRVHTGEKPYKCFVCGKGFSKSSLSSDSSESP

SEQ ID NO: 16043 - protein, 707 aa, Homo Sapiens; identical to SEQ ID NO: 16032

SEQ ID NO: 16044 - protein, 700 aa, Homo Sapiens
MTTFKEGLTFKDVAVVFTEEELGLLDPVQRNLYQDVMLENFRNLLSVGHHPFKHDVFLLEKEKKLDIMKTATQRKGKSADKIQSEVETVPEAGRHEELYWGQIWKQIASDLIKYEDSMISISRFPRQGDLSCQVRAGLYTTHTGQKFYQCDEYKKSFTDVFNFDLHQQLHSGEKSHTCDECGKSFCYISALHIHQRVHMGEKCYKCDVCGKEFSQSSHLQTHQRVHTVEKPFKCVECGKGFSRRSTLTVHCKLHSGEKPYNCEECGRAFIHASHLQEHQRIHTGEKPFKCDTCGKNFRRRSALNNHCMVHTGEKPYKCEDCGKCFTCSSNLRIHQRVHTGEKPYKCEECGKCFIQPSQFQAHRRIHTGEKPYVCKVCGKGFIYSSSFQAHQGVHTGEKPYKCNECGKSFRMKIHYQVHLVVHTGEKPYKCEVCGKAFRQSSYLKIHLKAHSVQKPFKCEECGQGFNQSSRLQIHQLIHTGEKPYKCEECGKGFSRRADLKIHCRIHTGEKPYNCEECGKVFSQASHLLTHQRVHSGEKPFKCEECGKSFSRSAHLQAHQKVHTGEKPYKCGECGKGFKWSLNLDMHQRVHTGEKPYTCGECGKHFSQASSLQLHQSVHTGEKPYKCDVCGKVFSRSSQLQYHRRVHTGEKPYKCEICGKRFSWRSNLVSHHKIHAAGTFYENDENSKNIRELSEGGSSTR

SEQ ID NO: 16045 - protein, 738 aa, Homo Sapiens
MTKFQEAVTFKDVAVAFTEEELGLLDSAQRKLYRDVMLENFRNLVSVGHQSFKPDMISQLEREEKLWMKELQTQRGKHSGDRNQNEMATLHKAGLRCFSLGELSCWQIKRHIASKLARSQDSMINIEGKSSQFPKHHDSPCQVGAGESIQASVDDNCLVNHIGDHSSIIENQEFPTGKVPNSWSKIYLNETQNYQRSCKQTQMKNKLCIFAPYVDIFSCISHHHDDNIVHKRDKVHSNSDCGKDTLKVSPLTQRSIHTGQKTYQGNECEEAFNDSSSLELHKQVHLGKKSPACSTHEKDTSYSSGIPVQQSVRTGKKRYWCHECGKGFSQSSNLQTHQRVHTGEKPYTCHECGKSFNQSSHLYAHLPIHTGEKPYRCDSCGKGFSRSTDLNIHCRVHTGEKPYKCEVCGKGFTQRSHLQAHERIHTGEKPYKCGDCGKRFSCSSNLHTHQRVHTEEKPYKCDECGKCFSLSFNLHSHQRVHTGEKPYKCEECGKGFSSASSFQSHQRVHTGEKPFRCNVCGKGFSQSSYFQAHQRVHTGEKPYKCEVCGKRFNWSLNLHNHQRVHTGEKPYKCEECGKGFSQASNLQAHQSVHTGEKPFKCDACQKRFSQASHLQAHQRVHTGEKPYKCDTCGKAFSQRSNLQVHQIIHTGEKPFKCEECGKEFSWSAGLSAHQRVHTGEKPYTCQQCGKGFSQASHFHTHQRVHTGERPYICDVCCKGFSQRSHLIYHQRVHTGGNL

SEQ ID NO: 16046 - protein, 1845 aa, Homo Sapiens
MGLCGLLERCWLHHDPDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHACAFCPAAFSQKGNLQSHVQRVHSEVKNGPTYNCTECSCVFKSLGSLNTHISKMHMGGPQNSTSSTETAHVLTATLFQTLPLQQTEAQATSASSQPSSQAVSDVIQQLLELSEPAPVESGQSPQPGQQLSITVGINQDILQQALENSGLSSIPAAAHPNDSCHAKTSAPHAQNPDVSSVSNEQTDPTDAEQEKEQESPEKLDKKEKKMIKKKSPFLPGSIREENGVRWHVCPYCAKEFRKPSDLVRHIRIHTHEKPFKCPQCFRAFAVKSTLTAHIKTHTGIKAFKCQYCMKSFSTSGSLKVHIRLHTGVRPFACPHCDKKFRTSGHRKTHIASHFKHTELRKMRHQRKPAKVRVGKTNIPVPDIPLQEPILITDLGLIQPIPKNQFFQSYFNNNFVNEADRPYKCFYCHRAYKKSCHLKQHIRSHTGEKPFKCSQCGRGFVSAGVLKAHIRTHTGLKSFKCLICNGAFTTGGSLRRHMGIHNDLRPYMCPYCQKTFKTSLNCKKHMKTHRYELAQQLQQHQQAASIDDSTVDQQSMQASTQMQVEIESDELPQTAEVVAANPEAMLDLEPQHVVGTEEAGLGQQLADQPLEADEDGFVAPQDPLRGHVDQFEEQSPAQQSFEPAGLPQGFTVTDTYHQQPQFPPVQQLQDSSTLESQALSTSFHQQSLLQAPSSDGMNVTTRLIQESSQEELDLQAQGSQFLEDNEDQSRRSYRCDYCNKGFKKSSHLKQHVRSHTGEKPYKCKLCGRGFVSSGVLKSHEKTHTGVKAFSCSVCNASFTTNGSLTRHMATHMSMKPYKCPFCEEGFRTTVHCKKHMKRHQTVPSAVSATGETEGGDICMEEEEEHSDRNASRKSRPEVITFTEEETAQLAKIRPQESATVSEKVLVQSAAEKDRISELRDKQAELQDEPKHANCCTYCPKSFKKPSDLVRHVRIHTGEKPYKCDECGKSFTVKSTLDCHVKTHTGQKLFSCHVCSNAFSTKGSLKVHMRLHTGAKPFKCPHCELRFRTSGRRKTHMQFHYKPDPKKARKPMTRSSSEGLQPVNLLNSSSTDPNVFIMNNSVLTGQFDQNLLQPGLVGQAILPASVSAGGDLTVSLTDGSLATLEGIQLQLAANLVGPNVQISGIDAASINNITLQIDPSILQQTLQQGNLLAQQLTGEPGLAPQNSSLQTSDSTVPASVVIQPISGLSLQPTVTSANLTIGPLSEQDSVLTTNSSGTQDLTQVMTSQGLVSPSGGPHEITLTINNSSLSQVLAQAAGPTATSSSGSPQEITLTISELNTTSGSLPSTTPMSPSAISTQNLVMSSSGVGGDASVTLTLADTQGMLSGGLDTVTLNITSQGQQFPALLTDPSLSGQGGAGSPQVILVSHTPQSASAACEEIAYQVAGVSGNLAPGNQPEKEGRAHQCLECDRAFSSAAVLMHHSKEVHGRERIHGCPVCRKAFKRATHLKEHMQTHQAGPSLSSQKPRVFKCDTCEKAFAKPSQLERHSRIHTGERPFHCTLCEKAFNQKSALQVHMKKHTGERPYKCAYCVMGFTQKSNMKLHMKRAHSYAGALQESAGHPEQDGEELSRTLHLEEVVQEAAGEWQALTHVF

SEQ ID NO: 16047 - protein, 458 aa, Homo Sapiens
MASTITGSQDCIVNHRGEVDGEPELDISPCQQWGEASSPISRNRDSVMTLQSGCFENIESETYLPLKVSSQIDTQDSSVKFCKNEPQDHQESRRLFVMEESTERKVIKGESCSENLQVKLVSDGQELASPLLNGEATCQNGQLKESLDPIDCNCKDIHGWKSQVVSCSQQRAHTEEKPCDHNNCGKILNTSPDGHPYEKIHTAEKQYECSQCGKNFSQSSELLLHQRDHTEEKPYKCEQCGKGFTRSSSLLIHQAVHTDEKPYKCDKCGKGFTRSSSLLIHHAVHTGEKPYKCDKCGKGFSQSSKLHIHQRVHTGEKPYECEECGMSFSQRSNLHIHQRVHTGERPYKCGECGKGFSQSSNLHIHRCIHTGEKPYQCYECGKGFSQSSDLRIHLRVHTGEKPYHCGKCGKGFSQSSKLLIHQRVHTGEKPYECSKCGKGFSQSSNLHIHQRVHKKDPR

SEQ ID NO: 16048 - protein, 368 aa, Homo Sapiens
MSAQSVEEDSILIIPTPDEEEKILRVKLEEDPDGEEGSSIPWNHLPDPEIFRQRFRQFGYQDSPGPREAVSQLRELCRLWLRPETHTKEQILELVVLEQFVAILPKELQTWVRDHHPENGEEAVTVLEDLESELDDPGQPVSLRRRKREVLVEDMVSQEEAQGLPSSELDAVENQLKWASWELHSLRHCDDDGRTENGALAPKQELPSALESHEVPGTLNMGVPQIFKYGETCFPKGRFERKRNPSRKKQHICDECGKHFSQGSALILHQRIHSGEKPYGCVECGKAFSRSSILVQHQRVHTGEKPYKCLECGKAFSQNSGLINHQRIHTGEKPYECVQCGKSYSQSSNLFRHQRRHNAEKLLNVVKV

SEQ ID NO: 16049 - protein, 579 aa, Homo Sapiens
MNKSQEQVSFKDVCVDFTQEEWYLLDPAQKILYRDVILENYSNLVSVGYCITKPEVIFKIEQGEEPWILEKGFPSQCHPERKWKVDDVLESSQENEDDHFWELLFHNNKTVSVENGDRGSKTFNLGTDPVSLRNYPYKICDSCEMNLKNISGLIISKKNCSRKKPDEFNVCEKLLLDIRHEKIPIGEKSYKYDQKRNAINYHQDLSQPSFGQSFEYSKNGQGFHDEAAFFTNKRSQIGETVCKYNECGRTFIESLKLNISQRPHLEMEPYGCSICGKSFCMNLRFGHQRALTKDNPYEYNEYGEIFCDNSAFIIHQGAYTRKILREYKVSDKTWEKSALLKHQIVHMGGKSYDYNENGSNFSKKSHLTQLRRAHTGEKTFECGECGKTFWEKSNLTQHQRTHTGEKPYECTECGKAFCQKPHLTNHQRTHTGEKPYECKQCGKTFCVKSNLTEHQRTHTGEKPYECNACGKSFCHRSALTVHQRTHTGEKPFICNECGKSFCVKSNLIVHQRTHTGEKPYKCNECGKTFCEKSALTKHQRTHTGEKPYECNACGKTFSQRSVLTKHQRIHTRVKALSTS

SEQ ID NO: 16050 - protein, 456 aa, Homo Sapiens
MNKFQGPVTLKDVIVEFTKEEWKLLTPAQRTLYKDVMLENYSHLVSVGYHVNKPNAVFKLKQGKEPWILEVEFPHRGFPEDLWSIHDLEARYQESQAGNSRNGELTKHQKTHTTEKACECKECGKFFCQKSALIVHQHTHSKGKSYDCDKCGKSFSKNEDLIRHQKIHTRDKTYECKECKKIFYHLSSLSRHLRTHAGEKPYECNQCEKSFYQKPHLTEHQKTHTGEKPFECTECGKFFYVKAYLMVHQKTHTGEKPYECKECGKAFSQKSHLTVHQRMHTGEKPYKCKECGKFFSRNSHLKTHQRSHTGEKPYECKECRKCFYQKSALTVHQRTHTGEKPFECNKCGKTFYYKSDLTKHQRKHTGEKPYECTECGKSFAVNSVLRLHQRTHTGEKPYACKECGKSFSQKSHFIIHQRKHTGEKPYECQECGETFIQKSQLTAHQKTHTKKRNAEK

SEQ ID NO: 16051 - protein, 560 aa, Homo Sapiens
MAAARLLPVPAGPQPLSFQAKLTFEDVAVLLSQDEWDRLCPAQRGLYRNVMMETYGNVVSLGLPGSKPDIISQLERGEDPWVLDRKGAKKSQGLWSDYSDNLKYDHTTACTQQDSLSCPWECETKGESQNTDLSPKPLISEQTVILGKTPLGRIDQENNETKQSFCLSPNSVDHREVQVLSQSMPLTPHQAVPSGERPYMCVECGKCFGRSSHLLQHQRIHTGEKPYVCSVCGKAFSQSSVLSKHRRIHTGEKPYECNECGKAFRVSSDLAQHHKIHTGEKPHECLECRKAFTQLSHLIQHQRIHTGERPYVCPLCGKAFNHSTVLRSHQRVHTGEKPHRCNECGKTFSVKRTLLQHQRIHTGEKPYTCSECGKAFSDRSVLIQHHNVHTGEKPYECSECGKTFSHRSTLMNHERIHTEEKPYACYECGKAFVQHSHLIQHQRVHTGEKPYVCGECGHAFSARRSLIQHERIHTGEKPFQCTECGKAFSLKATLIVHLRTHTGEKPYECNSCGKAFSQYSVLIQHQRIHTGEKPYECGECGRAFNQHGHLIQHQKVHRKL

SEQ ID NO: 16052 - protein, 671 aa, Homo Sapiens
MAATFQLPGHQEMPLTFQDVAVYFSQAEGRQLGPQQRALYRDVMLENYGNVASLGFPVPKPELISQLEQGKELWVLNLLGAEEPDILKSCQKDSEVGTKKELSILNQKFSEEVKTPEFVSRRLLRDNAQAAEFREAWGREGKLKERVGNSAGQSLNKPNIHKRVLTEATVGRERSLGERTQECSAFDRNLNLDQNVVRLQRNKTGERVFKCDICSKTFKYNSDLSRHQRSHTGEKPYECGRCGRAFTHSSNLVLHHHIHTGNKPFKCDECGKTFGLNSHLRLHRRIHTGEKPFGCGECGKAFSRSSTLIQHRIIHTGEKPYKCNECGRGFSQSPQLTQHQRIHTGEKPHECSHCGKAFSRSSSLIQHERIHTGEKPHKCNQCGKAFSQSSSLFLHHRVHTGEKPYVCNECGRAFGFNSHLTEHVRIHTGEKPYVCNECGKAFRRSSTLVQHRRVHTGEKPYQCVECGKAFSQSSQLTLHQRVHTGEKPYDCGDCGKAFSRRSTLIQHQKVHSGETRKCRKHGPAFVHGSSLTADGQIPTGEKHGRAFNHGANLILRWTVHTGEKSFGCNEYGKAFSPTSRPTEDQIMHAGEKPYKCQECGNAFSGKSTLIQHQVTHTGQKPCHCSVYGKAFSQSSQLTPPQQTRVGEKPALNDGSKRYFIHIKKIFQERHF

SEQ ID NO: 16053 - protein, 211 aa, Homo Sapiens
MLRQSCSFPVTSLPALGGVCGREGAGAEVPPAACGCEGRDPDTERSCGRSSTGGCSPCSGPGPSSPRTSRGALSPSLGRLFPHLQVVIKLRIQLAPAVHLALPTCSLLTSSPPLEGCCHRLNEEAEVQRGFRPIAVELEFENQPLGAETRLRNGRRAGVKRSEGRGQVRPGQVRSTGPEGGLTRMERKAARLQWDSGSIKMSENEQLWEEP

SEQ ID NO: 16054 - protein, 499 aa, Homo Sapiens
MGPLQFRDVAIEFSLEEWHCLDTAQRNLYRDVMLENYRNLVFLGIVVSKPDLVTCLEQGKKPLTMERHEMIAKPPVMSSHFAQDLWPENIQNSFQIGMLRRYEECRHDNLQLKKGCKSVGEHKVHKGGYNGLNQCLTTTQKEIFQCDKYGKVFHKFSNSNTYKTRHTGINLFKCIICGKAFKRSSTLTTHKKIHTGEKPYRCEECGKAFNQSANLTTHKRIHTGEKPYRCEECGKAFKQSSNLTTHKKIHTGEKPYKCEECGKAFNRSTDLTTHKIVHTGEKPYKCEECGKAFKHPSHVTTHKKIHTRGKPYNCEECGKSFKHCSNLTIHKRIHTGEKPYKCEECGKAFHLSSHLTTHKILHTGEKPYRCRECGKAFNHSTTLFSHEKIHTGEKPYKCDECGKTFTWPSILSKHKRTHTGEKPYKCEECGKSFTASSTLTTHKRIHTGEKPYKCEECGKAFNWSSDLNKHKKIHIERKPYIVKNVTDLLNVPPLLISIR

SEQ ID NO: 16055 - protein, 659 aa, Homo Sapiens
MPGPPRSLEMGLLTFRDVAIEFSLEEWQHLDIAQQNLYRNVMLENYRNLAFLGIAVSKPDLITCLEQGKEPWNMKRHEMVDEPPGMCPHFAQDLWPEQGMEDSFQKAILRRYGKYGHENLQLRKGCKSVDEYKVNKEGYNGLNQCFTTAQSKVFQCDKYLKVFYKFLNSNRPKIRHTEKKSFKCKKRVKLFCMLSHKTQHKSIYHREKSYKCKECGKTFNWSSTLTNHRKIYTEEKPYKCEEYNKSPKQLSTLTTHEIIHAGEKLYKCEECGEAFNRSSNLTTHKIIHTGEKPYKCEECGKAFIWSSTLTEHKKIHTRKKPYKCEECGKAFIWSSTLTRHKRMHTGEKPYKCEECGKAFSQSSTLTTHKIIHTGEKRYKCLECGKAFKQLSTLTTHKIIHVGEKLYKCEECGKGFNRSSNLTTHKIIHTGEKPYKCEECGKAFIWSSTLTKHKRIHTREKPYKCEECGKAFIWSSTLTRHKRMHTGEKPYKCEECGKSFSQSSTLTTHKIIHTGEKPYKCEECGKAFNWSSTLTKHKIIHTEEKPYKCEKCGKAFKQSSILTNHKRIHTGEKPYKCEECGKSFNRSSTFTKHKVIHTGVKPYKCEECGKAFFWSSTLTKHKRIHTGEQPYKWEKFGKAFNRSSHLTTDKITHWREILQV

SEQ ID NO: 16056 - protein, 627 aa, Homo Sapiens
MAAAELTAPAQGIVTFEDVAVYFSWKEWGLLDEAQKCLYHDVMLENLTLTTSLGGSGAGDEEAPYQQSTSPQRVSQVRIPKALPSPQKTNPCEICGPVLRQILHLVEHQGTHHGQKLYTDGACRKQLQFTAYLHQHQKQHVGQKHFRSNGGRDMFLSSCTFEVSGKPFTCKEVGKDFLVRSRFLQQQAAHTRKKSNRTKSAVAFHSVKNHYNWGECVKAFSYKHVRVQHQGDLIRERSYMCSECGKSFSTSCSLSDHLRVHTSEKPYTCGECGKSYRQSSSLITHRRIHTGVRPHQCDECGKLFNRKYDLLIHQRVHTGERPYKCSECGKSFSHSSSLITHQRIHTGMRPYECSECGKSFIHSSSLITHQRVHTGTRPYMCSECGKSFSQSCHLIKHRRLHIGEGPYECSECGKLFTYRSRFFQHQRVHTGVRSHECHECGKLFSRKFDLIVHERVHTGERPYECSECGKSFTCKSYLISHWKVHTGARPYECGECGKSFTHSSTLLQHQRVHTGERPYECNECGKFFSQSSSLIRHRRSHTGERPYECSECWKSFSNHSSLVKHRRVHTGERPYECSECGKSFSQSSNLTNHQRIHSGERPYECSDCGKFFTFNSNLLKHQNVHKG

SEQ ID NO: 16057 - protein, 563 aa, Homo Sapiens
MGPLTIRDVTVEFSLEEWHCLDTAQQNLYRDVMLENYRNLVFLGIAVSKPDLITCLEQGKEPCNMKRHEMVAKPPVMCSHIAEDLCPERDIKYFFQKVILRRYDKCEHENLQLRKGCKSVDECKVCKGGYNGLNQCLITTQSKMYQCDKYVKVFYKFSNSDRHKIRHTEKKTCKCKECGKSFCMLSQLTRHKRIHIRENSHKCEECGKAFNQSSALTRHKMTHTGEKPYKCEECGKAFNRSSHLTQHKVIHTREKPYKCEECGKAFNRSSHITQHKRIHNREKPFKYDECCKAFKWSSALTTLTQHKRIHTGEKPYKCEECGKAFNQSSALTRHKMIHTGEKPFQCEECGKAFNRSSHLTQHKIIHTKEKPYKCEECGKAFNRSSHLTKHKRIHTREKAYKCDEYCKAFNWSSALTTLTQHKIIHTGEKPYKCEECGKAFNRSSYLIRHKIIHTGEKPYKCEECGKAFNQSSHLTQHKIIHTGEKPYKCEECGKAFNRSSHLSQHKIIHTGEKPYKCEECGKPFNRFSYLTVHKRIHAGENPNKYEECGKACNHSSNLTKHNS

SEQ ID NO: 16058 - protein, 533 aa, Homo Sapiens; identical to SEQ ID NO: 14404

SEQ ID NO: 16059 - protein, 412 aa, Homo Sapiens
MIGMLESLQHESDLLQHDQIHTGEKPYECNECRKTFSLKQNLVEHKKMHTGEKSHECTECGKVCSRVSSLTLHLRSHTGKKAYKCNKCGKAFSQKENFLSHQKHHTGEKPYECEKVSIQMPTIIRHQKNHTGTKPYACKECGKAFNGKAYLTEHEKIHTGEKPFECNQCGRAFSQKQYLIKHQNIHTGKKPFKCSECGKAFSQKENLIIHQRIHTGEKPYECKGCGKAFIQKSSLIRHQRSHTGEKPYTCKECGKAFSGKSNLTEHEKIHIGEKPYKCNECGTIFRQKQYLIKHHNIHTGEKPYECNKCGKAFSRITSLIVHVRIHTGDKPYECKVCGKAFCQSSSLTVHMRSHTGEKPYGCNECGKAFSQFSTLALHMRIHTGEKPYQCSECGKAFSQKSHHIRHQRIHTH

SEQ ID NO: 16060 - protein, 683 aa, Homo Sapiens
MASGPGSQEREGLLIVKLEEDCAWSQELPPPDPGPSPEASHLRFRRFRFQEAAGPREALSRLQELCHGWLRPEMRTKEQILELLVLEQFLTILPQEIQSRVQELHPESGEEAVTLVEDMQRELGRLRQQVTNHGRGTEVLLEEPLPLETARESPSFKLEPMETERSPGPRLQELLGPSPQRDPQAVKERALSAPWLSLFPPEGNMEDKEMTGPQLPESLEDVAMYISQEEWGHQDPSKRALSRDTVQESYENVDSLESHIPSQEVPGTQVGQGGKLWDPSVQSCKEGLSPRGPAPGEEKFENLEGVPSVCSENIHPQVLLPDQARGEVPWSPELGRPHDRSQGDWAPPPEGGMEQALAGASSGRELGRPKELQPKKLHLCPLCGKNFSNNSNLIRHQRIHAAERLCMGVDCTEIFGGNPRFLSLHRAHLGEEAHKCLECGKCFSQNTHLTRHQRTHTGEKPYQCNICGKCFSCNSNLHRHQRTHTGEKPYKCPECGEIFAHSSNLLRHQRIHTGERPYKCPECGKSFSRSSHLVIHERTHERERLYPFSECGEAVSDSTPFLTNHGAHKAEKKLFECLTCGKSFRQGMHLTRHQRTHTGEKPYKCTLCGENFSHRSNLIRHQRIHTGEKPYTCHECGDSFSHSSNRIRHLRTHTGERPYKCSECGESFSRSSRLMSHQRTHTG

SEQ ID NO: 16061 - protein, 627 aa, Homo Sapiens
MAAAVLTDRAQVSVTFDDVAVTFTKEEWGQLDLAQRTLYQEVMLENCGLLVSLGCPVPKAELICHLEHGQEPWTRKEDLSQDTCPGDKGKPKTTEPTTCEPALSEGISLQGQVTQGNSVDSQLGQAEDQDGLSEMQEGHFRPGIDPQEKSPGKMSPECDGLGTADGVCSRIGQEQVSPGDRVRSHNSCESGKDPMIQEEENNFKCSECGKVFNKKHLLAGHEKIHSGVKPYECTECGKTFIKSTHLLQHHMIHTGERPYECMECGKAFNRKSYLTQHQRIHSGEKPYKCNECGKAFTHRSNFVLHNRRHTGEKSFVCTECGQVFRHRPGFLRHYVVHSGENPYECLECGKVFKHRSYLMWHQQTHTGEKPYECSECGKVFLESAALIHHYVIHTGEKPFECLECGKAFNHRSYLKRHQRIHTGEKPFVCSECGKAFTHCSTFILHKRAHTGEKPFECKECGKAFSNRKDLIRHFSIHTGEKPYECVECGKAFTRMSGLTRHKRIHSGEKPYECVECGKSFCWSTNLIRHAIIHTGEKPYKCSECGKAFSRSSSLTQHQRMHTGKNPISVTDVGRPFTSGQTSVTLRELLLGKDFLNVTTEANILPEETSSSASDQPYQRETPQVSSL

SEQ ID NO: 16062 - protein, 549 aa, Homo Sapiens
MLENYKNLATVGYQLFKPSLISWLEQEESRTVQRGDFQASEWKVQLKTKELALQQDVLGEPTSSGIQMIGSHNGGEVSDVKQCGDVSSEHSCLKTHVRTQNSENTFECYLYGVDFLTLHKKTSTGEQRSVFSQCGKAFSLNPDVVCQRTCTGEKAFDCSDSGKSFINHSHLQGHLRTHNGESLHEWKECGRGFIHSTDLAVRIQTHRSEKPYKCKECGKGFRYSAYLNIHMGTHTGDNPYECKECGKAFTRSCQLTQHRKTHTGEKPYKCKDCGRAFTVSSCLSQHMKIHVGEKPYECKECGIAFTRSSQLTEHLKTHTAKDPFECKICGKSFRNSSCLSDHFRIHTGIKPYKCKDCGKAFTQNSDLTKHARTHSGERPYECKECGKAFARSSRLSEHTRTHTGEKPFECVKCGKAFAISSNLSGHLRIHTGEKPFECLECGKAFTHSSSLNNHMRTHSAKKPFTCMECGKAFKFPTCVNLHMRIHTGEKPYKCKQCGKSFSYSNSFQLHERTHTGEKPYECKECGKAFSSSSSFRNHERRHADERLSA

SEQ ID NO: 16063 - protein, 743 aa, Homo Sapiens
MGLLTFRDVAVEFSLEEWEHLEPAQKNLYQDVMLENYRNLVSLGLVVSKPDLITFLEQRKEPWNVKSEETVAIQPDVFSHYNKDLLTEHCTEASFQKVISRRHGSCDLENLHLRKRWKREECEGHNGCYDEKTFKYDQFDESSVESLFHQQILSSCAKSYNFDQYRKVFTHSSLLNQQEEIDIWGKHHIYDKTSVLFRQVSTLNSYRNVFIGEKNYHCNNSEKTLNQSSSPKNHQENYFLEKQYKCKEFEEVFLQSMHGQEKQEQSYKCNKCVEVCTQSLKHIQHQTIHIRENSYSYNKYDKDLSQSSNLRKQIIHNEEKPYKCEKCGDSLNHSLHLTQHQIIPTEEKPCKWKECGKVFNLNCSLYLTKQQQIDTGENLYKCKACSKSFTRSSNLIVHQRIHTGEKPYKCKECGKAFRCSSYLTKHKRIHTGEKPYKCKECGKAFNRSSCLTQHQTTHTGEKLYKCKVCSKSYARSSNLIMHQRVHTGEKPYKCKECGKVFSRSSCLTQHRKIHTGENLYKCKVCAKPFTCFSNLIVHERIHTGEKPYKCKECGKAFPYSSHLIRHHRIHTGEKPYKCKACSKSFSDSSGLTVHRRTHTGEKPYTCKECGKAFSYSSDVIQHRRIHTGQRPYKCEECGKAFNYRSYLTTHQRSHTGERPYKCEECGKAFNSRSYLTTHRRRHTGERPYKCDECGKAFSYRSYLTTHRRSHSGERPYKCEECGKAFNSRSYLIAHQRSHTREKL

SEQ ID NO: 16064 - protein, 947 aa, Homo Sapiens
MATRVRTASIWVPPLQERNSSWDRIRKLQGQESILGQGTPGLQPLPGTPRQKQKSRRIEKVLEWLFISQEQPKITKSWGPLSFMDVFVDFTWEEWQLLDPAQKCLYRSVMLENYSNLVSLGYQHTKPDIIFKLEQGEELCMVQAQVPNQTCPNTVWKIDDLMDWHQENKDKLGSTAKSFECTTFGKLCLLSTKYLSRQKPHKCGTHGKSLKYIDFTSDYARNNPNGFQVHGKSFFHSKHEQTVIGIKYCESIESGKTVNKKSQLMCQQMYMGEKPFGCSCCEKAFSSKSYLLVHQQTHAEEKPYGCNECGKDFSSKSYLIVHQRIHTGEKLHECSECRKTFSFHSQLVIHQRIHTGENPYECCECGKVFSRKDQLVSHQKTHSGQKPYVCNECGKAFGLKSQLIIHERIHTGEKPYECNECQKAFNTKSNLMVHQRTHTGEKPYVCSDCGKAFTFKSQLIVHQGIHTGVKPYGCIQCGKGFSLKSQLIVHQRSHTGMKPYVCNECGKAFRSKSYLIIHTRTHTGEKLHECNNCGKAFSFKSQLIIHQRIHTGENPYECHECGKAFSRKYQLISHQRTHAGEKPYECTDCGKAFGLKSQLIIHQRTHTGEKPFECSECQKAFNTKSNLIVHQRTHTGEKPYSCNECGKAFTFKSQLIVHKGVHTGVKPYGCSQCAKTFSLKSQLIVHQRSHTGVKPYGCSECGKAFRSKSYLIIHMRTHTGEKPHECRECGKSFSFNSQLIVHQRIHTGENPYECSECGKAFNRKDQLISHQRTHAGEKPYGCSECGKAFSSKSYLIIHMRTHSGEKPYECNECGKAFIWKSLLIVHERTHAGVNPYKCSQCEKSFSGKLRLLVHQRMHTREKPYECSECGKAFIRNSQLIVHQRTHSGEKPYGCNECGKTFSQKSILSAHQRTHTGEKPCKCTECGKAFCWKSQLIMHQRTHVDDKH

SEQ ID NO: 16065 - protein, 569 aa, Homo Sapiens
MSSAPRGPPSVAPLPAGIGRSTAKTPGLPGSLEMGPLTFRDVAIEFSLEEWQCLDTSQQNLYRNVMLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGEKPYKCEECGKAFNQSSTLTRHKIVHTGEKPYKCEECGKAFKRSTTLTKHKRIYTKEKPYKCEECGKAFSVFSTLTKHKIIHTGAKPYKCEECGSAFRAFSTLTEHKRVHTGEKPYKCNECGKAFNWSSTLTKHKRIHTGEKPYKCEECGKAFNRSSNLTRHKKIHTGEKPYKPKRCDSAFDNTPNFSRHKRNHMGEKS

SEQ ID NO: 16066 - protein, 653 aa, Homo Sapiens
MASRLPTAWSCEPVTFEDVTLGFTPEEWGLLDLKQKSLYREVMLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAEGTTCCLEVTAQQEEKQEDAAICPVTVLPEEPVTFQDVAVDFSREEWGLLGPTQRTEYRDVMLETFGHLVSVGWETTLENKELAPNSDIPEEEPAPSLKVQESSRDCALSSTLEDTLQGGVQEVQDTVLKQMESAQEKDLPQKKHFDNRESQANSGALDTNQVSLQKIDNPESQANSGALDTNQVLLHKIPPRKRLRKRDSQVKSMKHNSRVKIHQKSCERQKAKEGNGCRKTFSRSTKQITFIRIHKGSQVCRCSECGKIFRNPRYFSVHKKIHTGERPYVCQDCGKGFVQSSSLTQHQRVHSGERPFECQECGRTFNDRSAISQHLRTHTGAKPYKCQDCGKAFRQSSHLIRHQRTHTGERPYACNKCGKAFTQSSHLIGHQRTHNRTKRKKKQPTS

SEQ ID NO: 16067 - protein, 429 aa, Homo Sapiens
MMSHPCVSLLGVPVLNPALVPHLAQGQVLLVSDPSPNTDPAKYSESTSATRHQMKGEDAQPQEMASTSFPRASGPSPEFRQHGDSDGKRGSPQNLPIEHHFACKECGDTFRLKVLLVQHQRVHSEEKGWECGDCGKVFRGVAEFNEHRKSHVAAEPQPGPSRALENAAEKREQMEREAKPFECEECGKRFKKNAGLSQHLRVHSREKPFDCEECGRSFKVNTHLFRHQKLHTSEKPFACKACSRDFLDRQELLKHQRMHTGHLPFDCDDCGKSFRGVNGLAEHQRIHSGAKPYGCPHCGKLFRRSSELTKHRRIHTGEKPYACGQCGKAFRQSSSLLEHARIHSGERPYACGECGKAFRGPSDLIKHRRIHSGLKPYECDKCGKAFRRSSGLSRHRRIHSGARRCECSQCGRVFKRRSALQKHQPTHHE

SEQ ID NO: 16068 - protein, 614 aa, Homo Sapiens
MKRDRLGRFLSPGSSRQCGASDGGGGVSRTRGRPSLSGGPRVDGATARRAWGPVGSCGDAGEDGADEAGAGRALAMGHCRLCHGKFSSRSLRSISERAPGASMERPSAEERVLVRDFQRLLGVAVRQDPTLSPFVCKSCHAQFYQCHSLLKSFLQRVNASPAGRRKPCAKVGAQPPTGAEEGACLVDLITSSPQCLHGLVGWVHGHAASCGALPHLQRTLSSEYCGVIQVVWGCDQGHDYTMDTSSSCKAFLLDSALAVKWPWDKETAPRLPQHRGWNPGDAPQTSQGRGTGTPVGAETKTLPSTDVAQPPSDSDAVGPRSGFPPQPSLPLCRAPGQLGEKQLPSSTSDDRVKDEFSDLSEGDVLSEDENDKKQNAQSSDESFEPYPERKVSGKKSESKEAKKSEEPRIRKKPGPKPGWKKKLRCEREELPTIYKCPYQGCTAVYRGADGMKKHIKEHHEEVRERPCPHPGCNKVFMIDRYLQRHVKLIHTEVRNYICDECGQTFKQRKHLLVHQMRHSGAKPLQCEVCGFQCRQRASLKYHMTKHKAETELDFACDQCGRRFEKAHNLNVHMSMVHPLTQTQDKALPLEAEPPPGPPSPSVTTEGQAVKPEPT

SEQ ID NO: 16069 - protein, 450 aa, Homo Sapiens
MAASKTQGAVARMQEDRDGSCSTVGGVGYGDSKDCILEPLSLPESPGGTTTLEGSPSVPCIFCEEHFPVAEQDKLLKHMIIEHKIVIADVKLVADFQRYILYWRKRFTEQPITDFCSVIRINSTAPFEEQENYFLLCDVLPEDRILREELQKQRLREILEQQQQERNDTNFHGVCMFCNEEFLGNRSVILNHMAREHAFNIGLPDNIVNCNEFLCTLQKKLDNLQCLYCEKTFRDKNTLKDHMRKKQHRKINPKNREYDRFYVINYLELGKSWEEVQLEDDRELLDHQEDDWSDWEEHPASAVCLFCEKQAETIEKLYVHMEDAHEFDLLKIKSELGLNFYQQVKLVNFIRRQVHQCRCYGCHVKFKSKADLRTHMEETKHTSLLPDRKTWDQLEYYFPTYENDTLLCTLSDSESDLTAQEQNENVPIISEDTSKLYALKQSSILNQLLL

SEQ ID NO: 16070 - protein, 718 aa, Homo Sapiens
MALPQGLLTFRDVAIEFSQEEWKCLDPAQRTLYRDVMLENYRNLVSLDISSKCMMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQKRYLACHRRSHIDEKPYKCNECGKIFGHNTSLFLHKALHTADKPYECEECDKVFSRKSHLETHKIIYTGGKPYKCKVCDKAFTCNSYLAKHTIIHTGEKPYKCNECGKVFNRLSTLARHRRLHTGEKPYECEECEKVFSRKSHLERHKRIHTGEKPYKCKVCDKAFAYNSYLAKHSIIHTGEKPYKCNECGKVFNQQSTLARHHRLHTAEKPYKCEECDKVFRCKSHLERHRRIHTGEKPYKCKVCDKAFRSDSCLTEHQRVHTGEKPYMCNECGKVFSTKANLACHHKLHTAEKPYKCEECEKVFSRKSHMERHRRIHTGEKPYKCKVCDKAFRRDSHLAQHQRVHTGEKPYKCNECGKTFRQTSSLIIHRRLHTGEKPYKCNECGKTFSQMSSLVYHHRLHSGEKPYKCNECGKVFNQQAHLAQHQRVHTGEKPYKCNECGKTFSQMSNLVYHHRLHSGEKP

SEQ ID NO: 16071 - protein, 542 aa, Homo Sapiens
MGDIFLCKKVESPKKNLRESKQREEDDEDPDLIYVGVEHVHRDAEVLFVGMISNSKPVVSNILNRVTPGSKSRRKKGHFRQYPAHVSQPANHVTSMAKAIMPVSLSEGRSTDSPVTMKSSSEPGYKMSSPQVVSPNYSDSLPPGTQCLVGAMVSGGGRNESSPDSKRLSTSDINSRDSKRVKLRDGIPGVPSLAVVPSDMSSTISTNTPSQGICNSSNHVQNGVTFPWPDANGKAHFNLTDPERANESGLAMTDISSLASQNKTFDPKKENPIVLLSNFYYGQHKGDGQPEQKTHTTFKCLSCVKVLKNIKFMNHMKHHLEFEKQRNDSWEDHTTCQHCHRQFPTPFQLQCHIDSVHIAMGPSAVCKICELSFETDQVLLQHMKDHHKPGEMPYVCQVCHYRSSVFADVETHFRTCHENTKNLLCLFCLKLFKTAIPYMNHCWRHSRRRVLQCSKCRLQFLTLKEEIEHKTKDHQTFKKPEQLQGFPRETKVIIQTSVQPGSSGMASVIVSNTDPQSSPVKTKKKTAMNTRDSRLPCSKDSS

SEQ ID NO: 16072 - protein, 543 aa, Homo Sapiens
MEQSCEEEKEPEPQKNIQETKQVDDEDAELIFVGVEHVNEDAELIFVGVTSNSKPVVSNILNRVTPGSWSRRKKYDHLRKDTARKLQPKSHETVTSEAVTVLPASQLESRSTDSPIIIEPLSKPDYRNSSPQVVPNNSSELPSPLITFTDSLHHPVSTALSVGGINESPRVSKQLSTFEVNSINPKRAKLRDGIIEGNSSASFPSDTFHTMNTQQSTPSNNVHTSLSHVQNGAPFPAAFPKDNIHFKPINTNLDRENELAKTDILSLTSQNKTFDPKKENPIVLLSDFYYGQHKGEGQPEQKTHTTFKCLSCVKVLKNVKFMNHVKHHLEFEKQRNDSWENHTTCQHCHRQFPTPFQLQCHIENVHTAQEPSTVCKICELSFETDQVLLQHMKDHHKPGEMPYVCQVCHYRSSVFADVETHFRTCHENTKNLLCPFCLKIFKTATPYMCHYRGHWGKSAHQCSKCRLQFLTFKEKMEHKTQCHQMFKKPKQLEGLPPETKVTIQVSLEPLQPGSVDVASITVSTSDSEPSLPRSKSKISKKSH

SEQ ID NO: 16073 - protein, 737 aa, Homo Sapiens
MDDDKPFQPKNISKMAELFMECEEEELEPWQKKVEETQDEDDDELIFVGEISSSKPAISNILNRGHSSSSSKGIKSEPHSPGIPEIFRTASQRCRDPPSNPVAASPRFHLVSKSSQSSVTVENASKPDFTKNSQVGSDNSSILLFDSTQESLPPSQDIPAIFREGMKNTSYVLKHPSTSKVNSVTPKKPKTSEDVPQINPSTSLPLIGSPPVTSSQVMLSKGTNTSSPYDAGADYLRACPKCNVQFNLLDPLKYHMKHCCPDMITKFLGVIVKSERPCDEDKTDSETGKLIMLVNEFYYGRHEGVTEKEPKTYTTFKCFSCSKVLKNNIRFMNHMKHHLELEKQNNESWENHTTCQHCYRQYPTPFQLQCHIESTHTPHEFSTICKICELSFETEHILLQHMKDTHKPGEMPYVCQVCQFRSSTFSDVEAHFRAAHENTKNLLCPFCLKVSKMATPYMNHYMKHQKKGVHRCPKCRLQFLTSKEKAEHKAQHRTFIKPKELEGLPPGAKVTIRASLGPLQSKLPTAPFGCAPGTSFLQVTPPTSQNTTARNPRKSNASRSKTSKLHATTSTASKVNTSKPRGRIAKSKAKPSYKQKRQRNRKNKMSLALKNIRCRRGIHKCIECHSKIKDFASHFSIYIHCSFCKYNTNCNKAFVNHMMSSHSNHPGKRFCIFKKHSGTLRGITLVCLKCDFLADSSGLDRMAKHLSQRKTHTCQVIIENVSKSTSTSEPTTGCSLK

SEQ ID NO: 16074 - protein, 979 aa, Homo Sapiens
MGDNPFQPKSNSKMAELFMECEEEELEPWQKKVKEVEDDDDDEPIFVGEISSSKPAISNILNRVNPSSYSRGLKNGALSRGITAAFKPTSQHYTNPTSNPVPASPINFHPESRSSDSSVIVQPFSKPGYITNSSRVVSNKSSELLFDLTQDTGLSHYQGGPTLSMAGMSESSFLSKRPSTSEVNNVNPKKPKPSESVSGANSSAVLPSVKSPSVTSSQAMLAKGTNTSSNQSKNGTPFPRACPKCNIHFNLLDPLKNHMKYCCPDMINNFLGLAKTEFSSTVNKNTTIDSEKGKLIMLVNDFYYGKHEGDVQEEQKTHTTFKCFSCLKILKNNIRFMNHMKHHLELEKQSSESWENHTTCQHCYRQFPTPFQLQCHIESTHTPHEFSTICKICELSFETEHVLLQHMKDNHKPGEMPYVCQVCNYRSSSFSDVETHFRTSHENTKNLLCPFCLKVIKIATPYMHHYMKHQKKGIHRCTKCRLQFLTCKEKMDHKTQHHRTFIKPKQLEGLPPGTKVTIRASVGPLQSGASPTPSISASASTLQLSPPRTKNITAKNPAKSNTSKPNTVKSNASKPNTSKPNGSKSKYKPKISNMQKKQSTLASSNKKSKVNTALRNLRYRRGIHKCIECCSEIKDFANHFPTYVHCSFCRYNTSCSKAYVNHMMSFHSNRPSKRFCIFKKHSENLRGITLVCLNCDFLSDVSGLDNMATHLSQHKTHTCQVVMQKVSVCIPTSEHLSELKKEAPAKEQEPVSKEIARPNMAERETETSNSESKQDKAASSKEKNGCNANSFEGSSTTKSEESITVSDKENETCLADQETGSKNIVSCDSNIGADKVEKKKQIQHVCQEMELKMCQSSENIILSDQIKDHNSSEARFSSKNIKDLRLASDNVSIDQFLRKRHEPESVSSDVSEQGSIHLEPLTPSEVLEYEATEILQKGSGDPSAKTDEVVSDQTDDIPGGNNPSTTEATVDLEDEKERS

SEQ ID NO: 16075 - protein, 895 aa, Homo Sapiens
MKIGSGFLSGGGGTGSSGGSGSGGGGSGGGGGGGSSGRRAEMEPTFPQGMVMFNHRLPPVTSFTRPAGSAAPPPQCVLSSSTSAAPAAEPPPPPAPDMTFKKEPAASAAAFPSQRTSWGFLQSLVSIKQEKPADPEEQQSHHHHHHHHYGGLFAGAEERSPGLGGGEGGSHGVIQDLSILHQHVQQQPAQHHRDVLLSSSSRTDDHHGTEEPKQDTNVKKAKRPKPESQGIKAKRKPSASSKPSLVGDGEGAILSPSQKPHICDHCSAAFRSSYHLRRHVLIHTGERPFQCSQCSMGFIQKYLLQRHEKIHSREKPFGCDQCSMKFIQKYHMERHKRTHSGEKPYKCDTCQQYFSRTDRLLKHRRTCGEVIVKGATSAEPGSSNHTNMGNLAVLSQGNTSSSRRKTKSKSIAIENKEQKTGKTNESQISNNINMQSYSVEMPTVSSSGGIIGTGIDELQKRVPKLIFKKGSRKNTDKNYLNFVSPLPDIVGQKSLSGKPSGSLGIVSNNSVETIGLLQSTSGKQGQISSNYDDAMQFSKKRRYLPTASSNSAFSINVGHMVSQQSVIQSAGVSVLDNEAPLSLIDSSALNAEIKSCHDKSGIPDEVLQSILDQYSNKSESQKEDPFNIAEPRVDLHTSGEHSELVQEENLSPGTQTPSNDKASMLQEYSKYLQQAFEKSTNASFTLGHGFQFVSLSSPLHNHTLFPEKQIYTTSPLECGFGQSVTSVLPSSLPKPPFGMLFGSQPGLYLSALDATHQQLTPSQELDDLIDSQKNLETSSAFQSSSQKLTSQKEQKNLESSTGFQIPSQELASQIDPQKDIEPRTTYQIENFAQAFGSQFKSGSRVPMTFITNSNGEVDHRVRTSVSDFSGYTNMMSDVSEPCSTRVKTPTSQSYR

SEQ ID NO: 16076 - protein, 671 aa, Homo Sapiens
MQFVSTRPQPQQLGIQGLGLDSGSWSWAQALPPEEVCHQEPALRGEMAEGMPPMQAQEWDMDARRPMPFQFPPFPDRAPVFPDRMMREPQLPTAEISLWTVVAAIQAVERKVDAQASQLLNLEGRTGTAEKKLADCEKTAVEFGNHMESKWAVLGTLLQEYGLLQRRLENLENLLRNRNFWVLRLPPGSKGEAPKVPVTFVDIAVYFSEDEWKNLDEWQKELYNNLVKENYKTLMSLDAEGSVPKPDAPVQAEPREEPCVWEQRHPEEREIPMDPEAGAEPLVPAQDASSQVKREDTLCVRGQRGLEERAIPTESITDSPISAQDLLSRIKQEEHQCVWDQQDLADRDIPTDPNSESLISAHDILSWIKQEEQPYPWGPRDSMDGELGLDSGPSDSLLMVKNPPPAPPQPQPQPQPPQPQLQSQPQPQSLPPIAVAENPGGPPSRGLLDDGFQVLPGERGSGEAPPGGDRSTGGGGGDGGGGGGGAEAGTGAGGGCGSCCPGGLRRSLLLHGARSKPYSCPECGKSFGVRKSLIIHHRSHTKERPYECAECEKSFNCHSGLIRHQMTHRGERPYKCSECEKTYSRKEHLQNHQRLHTGERPFQCALCGKSFIRKQNLLKHQRIHTGERPYTCGECGKSFRYKESLKDHLRVHSGGPGPGAPRQLPPPPERD

SEQ ID NO: 16077 - protein, 679 aa, Homo Sapiens
MESRSVAQAGVQWCDLGSLQAPPPGFTLFSCLSLLSSWDYSSGFSGFCASPIEESHGALISSCNSRTMTDGLVTFRDVAIDFSQEEWECLDPAQRDLYVDVMLENYSNLVSLDLESKTYETKKIFSENDIFEINFSQWEMKDKSKTLGLEASIFRNNWKCKSIFEGLKGHQEGYFSQMIISYEKIPSYRKSKSLTPHQRIHNTEKSYVCKECGKACSHGSKLVQHERTHTAEKHFECKECGKNYLSAYQLNVHQRFHTGEKPYECKECGKTFSWGSSLVKHERIHTGEKPYECKECGKAFSRGYHLTQHQKIHTGVKSYKCKECGKAFFWGSSLAKHEIIHTGEKPYKCKECGKAFSRGYQLTQHQKIHTGKKPYECKICGKAFCWGYQLTRHQIFHTGEKPYECKECGKAFNCGSSLIQHERIHTGEKPYECKECGKAFSRGYHLSQHQKIHTGEKPFECKECGKAFSWGSSLVKHERVHTGEKSHECKECGKTFCSGYQLTRHQVFHTGEKPYECKECGKAFNCGSSLVQHERIHTGEKPYECKECGKAFSRGYHLTQHQKIHTGEKPFKCKECGKAFSWGSSLVKHERVHTNEKSYECKDCGKAFGSGYQLSVHQRFHTGEKLYQRKEFGKTFTCGSKLVHERTHSNDKPYKYNECGEAFLWTTYSNEKIDTDETL

SEQ ID NO: 16078 - protein, 593 aa, Homo Sapiens
MTMFKEAVTFKDVAVVFTEEELGLLDVSQRKLYRDVMLENFRNLLSVGHQLSHRDTFHFQREEKFWIMETATQREGNSGGKIQTELESVPETGPHEEWSCQQIWEQTASELTRPQDSISSSQFSTQGDVPSQVDAGLSIIHIGETPSEHGKCKKFFSDVSILDLHQQLHSGKISHTCNEYRKRFCYSSALCLHQKVHMGEKRYKCDVCSKAFSQNSQLQTHQRIHTGEKPFKCEQCGKSFSRRSGMYVHCKLHTGEKPHICEECGKAFIHNSQLREHQRIHTGEKPFKCYICGKSFHSRSNLNRHSMVHMQEKSFRCDTCSNSFGQRSALNSHCMDHTKEKLYKCEECGRSFTCRQDLCKHQMDHTGDKPYNCNVCGKGFRWSSCLSRHQRVHNGETTFKCDGCGKRFYMNSQGHSHQRAYREEELYKCQKCGKGYISKFNLDLHQRVHTGERPYNCKECGKSFRWASGILRHKRLHTGEKPFKCEECGKRFTENSKLRFHQRIHTGEKPYKCEECGKGFRWASTHLTHQRLHSREKLFQCEDCGKSSEHSSCLQDQQSDHSGEKTSKCEDCGKRYERRLNLDMILSLFLNDI

SEQ ID NO: 16079 - protein, 590 aa, Homo Sapiens
MIKFQERVTFKDVAVVFTKEELALLDKAQINLYQDVMLENFRNLMLVRDGIKNNILNLQAKGLSYLSQEVLHCWQIWKQRIRDLTVSQDYIVNLQEECSPHLEDVSLSEEWAGISLQISENENYVVNAIIKNQDITAWQSLTQVLTPESWRKANIMTEPQNSQGRYKGIYMEEKLYRRAQHDDSLSWTSCDHHESQECKGEDPGRHPNCGKNLGMKSTVEKRNAAHVLPQPFPCNNCGVAFADDTDPHVHHSTHLGEKSYKCDQYGKNFSQSQDLIVHCKTHSGKTPYEFHEWPMGCKQSSDLPRYQKVSSGDKPYKCKECGKGFRRSSSLHNHHRVHTGEMPYKCDECGKGFGFRSLLCIHQGVHTGKKPYKCEECGKGFDQSSNLLVHQRVHTGEKPYKCSECGKCFSSSSVLQVHWRFHTGEKPYRCGECGKGFSQCTHLHIHQRVHTGEKPYKCNVCGKDFAYSSVLHTHQRVHTGEKPYKCEVCGKCFSYSSYFHLHQRDHIREKPYKCDECGKGFSRNSDLNVHLRVHTRERPYKCKACGKGFSRNSYLLAHQRVHIDETQYTHCERGKDLLTHQRLHEQRETL

SEQ ID NO: 16080 - protein, 521 aa, Homo Sapiens
METDLAEMPEKGALSSQDSPHFQEKSTEEGEVAALRLTARSQETVTFKDVAMDFTPEEWGKLDPAQRDVMLENYRNLVSLWLPVSKPESYNLENGKEPLKLERKAPKSSYSDMETRPQSKDSTSVQDFSKAESCKVAIIDRLTRNSVYDSNLEAALECENWLENQQGNQERHLREMFTHMNSLSEETDHKHDVYWKSFNQKSVLITEDRVPKGSYAFHTLEKSLKQKSNLMKKQRTYKEKKPHKCNDCGELFTYHSVLIRHQRVHTGEKPYTCNECGKSFSHRANLTKHQRTHTRILFECSECKKTFTESSSLATHQRIHVGERPYECNECGKGFNRSTHLVQHQLIHTGVKPYECNECDKAFIHSSALIKHQRTHTGEKPYKCQECGKAFSHCSSLTKHQRVHTGEKPYECSECGKTFSQSTHLVQHQRIHTGEKPYECNECGKTFSRSSNFAKHQRIHIGKKPYKCSECGKAFIHSSALIQHQRTHTGEKPFRCNECGKSFKCSSSLIRHQRVHTEEQP

SEQ ID NO: 16081 - protein, 522 aa, Homo Sapiens
METDLAEMPEKGVLSSQDSPHFQEKSTEEGEVAALRLTARSQAAAAAAAPGSRSLRGVHVPPPLHPAPAREEIKSTCSLKACFSLSLTLTYYRTAFLLSTENEGNLHFQCPSDVETRPQSKDSTSVQDFSKAESCKVAIIDRLTRNSVYDSNLEAALECENWLEKQQGNQERHLREMFTHMNSLSEETDHEHDVYWKSFNQKSVLITEDRVPKGSYAFHTLEKSLKQKSNLMKKQRTYKEKKPHKCNDCGELFTCHSVHIQHQRVHTGEKPYTCNECGKSFSHRANLTKHQRTHTRILFECRECKKTFTESSSLATHQRIHVGERPYECNECGKGFNRSTHLVQHQLIHTGVRPYECNECDKAFIHSSALIKHQRTHTGEKPYKCQECGKAFSHCSSLTKHQRVHTGEKPYECSECGKTFSQSTHLVQHQRIHTGEKPYECSECGKTFSQSSNFAKHQRIHIGKKPYKCSECGKAFIHSSALIQHQRTHTGEKPFRCNECGKSFKCSSSLIRHQRVHTEEQP

SEQ ID NO: 16082 - protein, 754 aa, Homo Sapiens
MNSSSRSQILLRWKSDKAQSGPYNVEKEILTSRFLRDTETCRQNFRNFPYPDLAGPRKALSQLRELCLKWLRPEIHSKEQILELLVLEQFLTILPGEVRTWVKSQYPESSEEAVTLVEDLTQILEEEAPQNSTLSQDTPEEDPRGKHAFQTGWLNDLVTKESMTFKDVAVDITQEDWELMRPVQKELYKTVTLQNYWNMVSLGLTVYRPTVIPILEEPWMVIKEILEGPSPEWETKAQACTPVEDMSKLTKEETHTIKLEDSYDYDDRLERRGKGGFWKIHTDERGFSLKSVLSQEYDPTEECLSKYDIYRNNFEKHSNLIVQFDTQLDNKTSVYNEGRATFNHVSYGIVHRKILPGEKPYKCNVCGKKFRKYPSLLKHQSTHAKEKSYECEECGKEFRHISSLIAHQRMHTGEKPYECHQCGKAFSQRAHLTIHQRIHTGEKPYKCDDCGKDFSQRAHLTIHQRTHTGEKPYKCLECGKTFSHSSSLINHQRVHTGEKPYICNECGKTFSQSTHLLQHQKIHTGKKPYKCNECWKVFSQSTYLIRHQRIHSGEKCYKCNECGKAFAHSSTLIQHQTTHTGEKSYICNICGKAFSQSANLTQHHRTHTGEKPYKCSVCGKAFSQSVHLTQHQRIHNGEKPFKCNICGKAYRQGANLTQHQRIHTGEKPYKCNECGKAFIYSSSLNQHQRTHTGERPYKCNECDKDFSQRTCLIQHQRIHTGEKPYACRICGKTFTQSTNLIQHQRVHTGAKHRN

SEQ ID NO: 16083 - protein, 2723 aa, Homo Sapiens
MADEEAEQERLSCGEGGCVAELQRLGERLQELELQLRESRVPAVEAATDYCQQLCQTLLEYAEKWKTSEDPLPLLEVYTVAIQSYVKARPYLTSECENVALVLERLALSCVELLLCLPVELSDKQWEQFQTLVQVAHEKLMENGSCELHFLATLAQETGVWKNPVLCTILSQEPLDKDKVNEFLAFEGPILLDMRIKHLIKTNQLSQATALAKLCSDHPEIGIKGSFKQTYLVCLCTSSPNGKLIEEISEVDCKDALEMICNLESEGDEKSALVLCTAFLSRQLQQGDMYCAWELTLFWSKLQQRVEPSIQVYLERCRQLSLLTKTVYHIFFLIKVINSETEGAGLATCIELCVKALRLESTENTEVKISICKTISCLLPDDLEVKRACQLSEFLIEPTVDAYYAVEMLYNQPDQKYDEENLPIPNSLRCELLLVLKTQWPFDPEFWDWKTLKRQCLALMGEEASIVSSIDELNDSEVYEKVVDYQEESKETSMNGLSGGVGANSGLLKDIGDEKQKKREIKQLRERGFISARFRNWQAYMQYCVLCDKEFLGHRIVRHAQKHYKDGIYSCPICAKNFNSKETFVPHVTLHVKQSSKERLAAMKPLRRLGRPPKITTTNENQKTNTVAKQEQRPIKKNSLYSTDFIVFNDNDGSDDENDDKDKSYEPEVIPVQKPVPVNEFNCPVTFCKKGFKYFKNLIAHVKGHKDNEDAKRFLEMQSKKVICQYCRRHFVSVTHLNDHLQMHCGSKPYICIQMKCKAGFNSYAELLTHRKEHQVFRAKCMFPKCGRIFSEAYLLYDHEAQHYNTYTCKFTGCGKVYRSQGELEKHLDDHSTPPEKVLPPEAQLNSSGDSIQPSEVNQNTAENIEKERSMLPSENNIENSLLADRSDAWDKSKAESAVTKQDQISASELRQANGPLSNGLENPATTPLLQSSEVAVSIKVSLNQGIEDNFGKQENSTVEGSGEALVTDLHTPVEDTCNDLCHPGFQERKEQDCFNDAHVTQNSLVNSETLKIGDLTPQNLERQVNNLMTFSVQNQAAFQNNLPTSKFECGDNVKTSSNLYNLPLKTLESIAFVPPQSDLSNSLGTPSVPPKAPVQKFSCQVEGCTRTYNSSQSIGKHMKTAHPDQYAAFKMQRKSKKGQKANNLNTPNNGKFVYFLPSPVNSSNPFFTSQTKANGNPACSAQLQHVSPPIFPAHLASVSTPLLSSMESVINPNITSQDKNEQGGMLCSQMENLPSTALPAQMEDLTKTVLPLNIDSGSDPFLPLPAESSSMSLFPSPADSGTNSVFSQLENNTNHYSSQIEGNTNSSFLKGGNGENAVFPSQVNVANNFSSTNAQQSAPEKVKKDRGRGPNGKERKPKHNKRAKWPAIIRDGKFICSRCYRAFTNPRSLGGHLSKRSYCKPLDGAEIAQELLQSNGQPSLLASMILSTNAVNLQQPQQSTFNPEACFKDPSFLQLLAENRSPAFLPNTFPRSGVTNFNTSVSQEGSEIIKQALETAGIPSTFEGAEMLSHVSTGCVSDASQVNATVMPNPTVPPLLHTVCHPNTLLTNQNRTSNSKTSSIEECSSLPVFPTNDLLLKTVENGLCSSSFPNSGGPSQNFTSNSSRVSVISGPQNTRSSHLNKKGNSASKRRKKVAPPLIAPNASQNLVTSDLTTMGLIAKSVEIPTTNLHSNVIPTCEPQSLVENLTQKLNNVNNQLFMTDVKENFKTSLESHTVLAPLTLKTENGDSQMMALNSCTTSINSDLQISEDNVIQNFEKTLEIIKTAMNSQILEVKSGSQGAGETSQNAQINYNIQLPSVNTVQNNKLPDSSPFSSFISVMPTKSNIPQSEVSHKEDQIQEILEGLQKLKLENDLSTPASQCVLINTSVTLTPTPVKSTADITVIQPVSEMINIQFNDKVNKPFVCQNQGCNYSAMTKDALFKHYGKIHQYTPEMILEIKKNQLKFAPFKCVVPTCTKTFTRNSNLRAHCQLVHHFTTEEMVKLKIKRPYGRKSQSENVPASRSTQVKKQLAMTEENKKESQPALELRAETQNTHSNVAVIPEKQLVEKKSPDKTESSLQVITVTSEQCNTNALTNTQTKGRKIRRHKKEKEEKKRKKPVSQSLEFPTRYSPYRPYRCVHQGCFAAFTIQQNLILHYQAVHKSDLPAFSAEVEEESEAGKESEETETKQTLKEFRCQVSDCSRIFQAITGLIQHYMKLHEMTPEEIESMTASVDVGKFPCDQLECKSSFTTYLNYVVHLEADHGIGLRASKTEEDGVYKCDCEGCDRIYATRSNLLRHIFNKHNDKHKAHLIRPRRLTPGQENMSSKANQEKSKSKHRGTKHSRCGKEGIKMPKTKRKKKNNLENKNAKIVQIEENKPYSLKRGKHVYSIKARNDALSECTSRFVTQYPCMIKGCTSVVTSESNIIRHYKCHKLSKAFTSQHRNLLIVFKRCCNSQVKETSEQEGAKNDVKDSDTCVSESNDNSRTTATVSQKEVEKNEKDEMDELTELFITKLINEDSTSVETQANTSSNVSNDFQEDNLCQSERQKASNLKRVNKEKNVSQNKKRKVEKAEPASAAELSSVRKEEETAVAIQTIEEHPASFDWSSFKPMGFEVSFLKFLEESAVKQKKNTDKDHPNTGNKKGSHSNSRKNIDKTAVTSGNHVCPCKESETFVQFANPSQLQCSDNVKIVLDKNLKDCTELVLKQLQEMKPTVSLKKLEVHSNDPDMSVMKDISIGKATGRGQY

SEQ ID NO: 16084 - protein, 475 aa, Homo Sapiens
MSRRKAGSAPRRVEPAPAANPDDEMEMQDLVIELKPEPDAQPQQAPRLGPFSPKEVSSAGRFGGEPHHSPGPMPAGAALLALGPRNPWTLWTPLTPNYPDRQPWTDKHPDLLTCGRCLQTFPLEAITAFMDHKKLGCQLFRGPSRGQGSEREELKALSCLRCGKQFTVAWKLLRHAQWDHGLSIYQTESEAPEAPLLGLAEVAAAVSAVVGPAAEAKSPRASGSGLTRRSPTCPVCKKTLSSFSNLKVHMRSHTGERPYACDQCPYACAQSSKLNRHKKTHRQVPPQSPLMADTSQEQASAAPPEPAVHAAAPTSTLPCSGGEGAGAAATAGVQEPGAPGSGAQAGPGGDTWGAITTEQRTDPANSQKASPKKMPKSGGKSRGPGGSCEFCGKHFTNSSNLTVHRRSHTGERPYTCEFCNYACAQSSKLNRHRRMHGMTPGSTRFECPHCHVPFGLRATLDKHLRQKHPEAAGEA

SEQ ID NO: 16085 - protein, 446 aa, Homo Sapiens
METQADLVSQEPQALLDSALPSKVPAFSDKDSLGDEMLAAALLKAKSQELVTFEDVAVYFIRKEWKRLEPAQRDLYRDVMLENYGNVFSLDRETRTENDQEISEDTRSHGVLLGRFQKDISQGLKFKEAYEREVSLKRPLGNSPGERLNRKMPDFGQVTVEEKLTPRGERSEKYNDFGNSFTVNSNLISHQRLPVGDRPHKCDECSKSFNRTSDLIQHQRIHTGEKPYECNECGKAFSQSSHLIQHQRIHTGEKPYECSDCGKTFSCSSALILHRRIHTGEKPYECNECGKTFSWSSTLTHHQRIHTGEKPYACNECGKAFSRSSTLIHHQRIHTGEKPYECNECGKAFSQSSHLYQHQRIHTGEKPYECMECGGKFTYSSGLIQHQRIHTGENPYECSECGKAFRYSSALVRHQRIHTGEKPLNGIGMSKSSLRVTTELNIREST

SEQ ID NO: 16086 - protein, 623 aa, Homo Sapiens
MAHKYVGLQYHGSVTFEDVAIAFSQQEWESLDSSQRGLYRDVMLENYRNLVSMGHSRSKPHVIALLEQWKEPEVTVRKDGRRWCTDLQLEDDTIGCKEMPTSENCPSFALHQKISRQKPRECQEYGKTLCQDSKPVQHERIHSSEKPNRCKECGKNFSNGHQLTIHQRLHVGEKPYKYEKCGKAFISGSAFVKHGRIHTGEKPLKCKQCGKTISGSYQLTVHKSIHTGKKPYECGECGKAFLVYGKLTRHQSTHTGEKPFGCEECGKAFSTFSYLVQHQRIHTSEKPYECKECGKAFSTSSPLAKHQRIHTGEKPYECKECGKSFTVYGQLTRHQSIHTGEKPFECKECGKAFRLSSFLHAHQRIHAEIKPYGCKECGRTFSRASYLVQHGRLHTGEKPYECKECGKAFSTGSYLVQHQRIHTGEKPYECKECGKAFISRHQLTVHQRVHTGEKPYECKECGKAFRVHVHLTQHRKIHTDVKPYECKECGKTFSRASYLVQHSRIHTGKKPYECKECGKAFSSGSYLVQHQRIHTGEKPYECNKCGKAFTVYGQLIGHQSVHTGEKPFECKECGKAFRLNSFLTEHQRVHTGEKPFKCKKCGKTFRYSSALKVHLRKHMSVIP

SEQ ID NO: 16087 - protein, 604 aa, Homo Sapiens
MMKSQGLVSFKDVAVDFTQEEWQQLDPSQRTLYRDVMLENYSHLVSMGYPVSKPDVISKLEQGEEPWIIKGDISNWIYPDEYQADGRQDRKSNLHNSQSCILGTVSFHHKILKGVTRDGSLCSILKVCQGDGQLQRFLENQDKLFRQVTFVNSKTVTEASGHKYNPLGKIFQECIETDISIQRFHKYDAFKKNLKPNIDLPSCYKSNSRKKPDQSFGGGKSSSQSEPNSNLEKIHNGVIPFDDNQCGNVFRNTQSLIQYQNVETKEKSCVCVTCGKAFAKKSQLIVHQRIHTGKKPYDCGACGKAFSEKFHLVVHQRTHTGEKPYDCSECGKAFSQKSSLIIHQRVHTGEKPYECSECGKAFSQKSPLIIHQRIHTGEKPYECRECGKAFSQKSQLIIHHRAHTGEKPYECTECGKAFCEKSHLIIHKRIHTGEKPYKCAQCEEAFSRKTELITHQLVHTGEKPYECTECGKTFSRKSQLIIHQRTHTGEKPYKCSECGKAFCQKSHLIGHQRIHTGEKPYICTECGKAFSQKSHLPGHQRIHTGEKPYICAECGKAFSQKSDLVLHQRIHTGERPYQCAICGKAFIQKSQLTVHQRIHTVVKS

SEQ ID NO: 16088 - protein, 478 aa, Homo Sapiens
MSQVTFSDVAIDFSHEEWACLDSAQRDLYKDVMVQNYENLVSVGLSVTKPYVIMLLEDGKEPWMMEKKLSKAYPFPLSHSVPASVNFGFSALFEHCSEVTEIFELSELCVFWVLHFLSNSPNSTVEAFSRSKKKKKKKKKRQCFAFLIYFRLGIKMGKQGIINKEGYLYEDSPQPVTMEKVVKQSYEFSNSNKNLEYTECDTFRSTFHSKSTLSEPQNNSAEGNSHKYDILKKNLSKKSVIKSERINGGKKLLNSNKSGAAFNQSKSLTLPQTCNREKIYTCSECGKAFGKQSILSRHWRIHTGEKPYECRECGKTFSHGSSLTRHQISHSGEKPYKCIECGKAFSHGSSLTNHQSTHTGEKPYECMNCGKSFSRVSLLIQHLRIHTQEKRYECRICGKAFIHSSSLIHHQKSHTGEKPYECRECGKAFCCSSHLTQHQRIHSMKKKYECNKCLKVFSSFSFLVQHQSIHTEEKPFEV

SEQ ID NO: 16089 - protein, 659 aa, Homo Sapiens
MAAAVLMDRVQSCVTFEDVFVYFSREEWELLEEAQRFLYRDVMLENFALVATLGFWCEAEHEAPSEQSVSVEGVSQVRTAESGLFQKAHPCEMCDPLLKDILHLAEHQGSHLTQKLCTRGLCRRRFSFSANFYQHQKQHNGENCFRGDDGGASFVKSCTVHMLGRSFTCREEGMDLPDSSGLFQHQTTYNRVSPCRRTECMESFPHSSSLRQHQGDYDGQMLFSCGDEGKAFLDTFTLLDSQMTHAEVRPFRCLPCGNVFKEKSALINHRKIHSGEISHVCKECGKAFIHLHHLKMHQKFHTGKRHYTCSECGKAFSRKDTLVQHQRVHTGERSYDCSECGKAYSRSSHLVQHQRIHTGERPYKCNKCGKAFSRKDTLVQHQRFHTGERPYECSECGKFFSQSSHLIEHWRIHTGARPYECIECGKFFSHNSSLIKHRRVHTGARSYVCSKCGKAFGCKDTLVQHQIIHTGARPYECSECGKAFSRKDTLVQHQKIHTGERPYECGECGKFFSHSSNLIVHQRIHTGAKPYECNECGKCFSHNSSLILHQRVHTGARPYVCSECGKAYISSSHLVQHKKVHTGARPYECSECGKFFSRNSGLILHQRVHTGEKPYVCSECGKAYSRSSHLVRHQKAHTGERAHECNSFGGPLAASLKLV

SEQ ID NO: 16090 - protein, 666 aa, Homo Sapiens
MQEVVLLDESSGPPSQLLWTRQDTQLPQESALLPAPYPAFTKDGSQGNLPQADITLMSQAQESVTFEDVAVNFTNREWQCLTYAQRHLYKDVMLENYGNMVSLGFPFPKPPLISHLEREVDPCVQDPQDRESLSCSYPVSADKMWPENEKASSQQEIFENGEAYWMKFNSLLKVDSRDPKVREVCVQDVKLENQWETSIREKLREEKEGSEEVTCKKGKNQKVLSKNLNPNSKHSQCNKVLIAQKLHECARCGKNFSWHSDLILHEQIHSGEKPHVCNECGKAFKTRNQLSMHRIIHTGEKPFNCTQCGKAFNSRSALCRHKKTHSGEKPHECRDCGKAFKTRNRLCMHQLIHTGEKPYKCNCCGKAFQFKHSLTIHGRIHTGEKPYECEECGKAFSGSSDLTKHIRIHTGERPYECSKCGRAFSRSSDLSKHKRIHTREKHYGCPQCGKDFSIKAELTKHRRIHTEEKRYRCEECGKAFRHNCKRRAHEREHTGEKPYQCRDCGKTFQDKHCLTIHQRIHTGEKPYKCLECGKAFSGKSNLTNHRRIHTGEKPHKCEVCGMAFHHSSVLRQHKRIHTGEKPYTCSECGTSFRQGSALIGHKRVHTGEKPYECEECGKAFRVSSNLTGHKKRKHQVWSTHELDGSRKSLSPVTVSQTSVVSILTSA

SEQ ID NO: 16091 - protein, 1004 aa, Homo Sapiens
MAALHTTPDSPAAQLERAEDGSECDPDQEEEEEEEEKGEEVQEVEEEEEEIVVEEEEEGVAEVVQDAQVEAVAEVEVEADVEEEDVKEVLAEEECPALGTQERLSRGGDAKSPVLQEKGLQASRAPATPRDEDLEEEEEEEEDEDEDDLLTAGCQELVTFEDVAVYFSLEEWERLEADQRGLYQEVMQENYGILVSLGYPIPKPDLIFRLEQGEEPWVPDSPRPEEGDIVTGVYTGAWFWTDDIEDHEEEDDEDFLAEVAEEENEPPGLWSAAYGVGDVPGTWGPDDSDSAQTPEGWGPDPGGLGVLADGSEAKPFLPGREPGANLLSPWAFPAAVAPPAGRPETTCDVCGKVFPHRSRLAKHQRYHAAVKPFGCEECGKGFVYRSHLAIHQRTHTGEKPFPCPDCGKRFVYKSHLVTHRRIHTGERPYRCAFCGAGFGRRSYLVTHQRTHTGERPYPCSHCGRSFSQSSALARHQAVHTADRPHCCPDCGQAFRLRADFQRHRRGGGCAEAGGDGPRREPGETAAAAGPEDTDPGPEGSEVGEADGEAEAAAEEREEAAVAAPTPSGKVDPAPERRFLELGNGLGEGEGPSSHPLGFHFPVHPKSWLHPDSFPILGLPDFRERLPVDGRPLPAPLGGPLSLVEGTGLACDPFGGGGAAGGGGGLRAFGPAIGGLLAEPAPAALAEEESPWICSDCGKTFGRRAALAKHQRYHAGERPHRCADCGKSFVYGSHLARHRRTHTGERPFPCPECGARFARGSHLAAHVRGHTGEKPFVCGVCGAGFSRRAHLTAHGRAHTGERPYACGECGRRFGQSAALTRHQWAHAEEKPHRCPDCGKGFGHSSDFKRHRRTHTGEKPFRCADCGRGFAQRSNLAKHRRGHTGERPFPCPECGKRFSQRSVLVTHQRTHTGERPYACANCGRRFSQSSHLLTHMKTHRGATAAPGSGSAPAPAPKPEAAAKGPSSAGPGERGSALLEFAGGTSFGSEHQAAFAGPSGAYREGVL

SEQ ID NO: 16092 - protein, 595 aa, Homo Sapiens
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLGYQVGKPSLISHLEQEEEPRTEERGAHQGACADWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHMRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHRGEKLFVSSVWKRLQ

SEQ ID NO: 16093 - protein, 2279 aa, Homo Sapiens
MYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNREKLKGYSIRSEERSREAKRPRYDDTVKINSMGGDHPSFTSGTRNYRQRRRSPSPRFLDPEFRELDLARRKREEEEERSRSLSQELVGVDGGGTGCSIPGLSGVLTASEPGYSLHRPEEVSVMPKKSILKKRIEVDIMEPSMQLESFSSSTSSSQDHPLYSGHPSLPLSGAIAAFASEIENKGTMVETALKEPQGNLYQWGPLPGIPKDNSPLREKFGSFLCHKDNLDLKAEGPERHTDFLLPHERASQDGSGFSRILSMLADSTSTQEKRRRSFPDIEDEEKFLYGDEEEDLKAESVPKPLGSSESEVMRQKASSLPSSAPAVKLESLEETNPEYAKIHDLLKTIGLDIGVAEISQLAARTQERLHGKKPSLRSSADRRSSVDRYFSADHCSSVDHRFSADRCSSVDHCFSADRRSSDPHRLESREAHHSNTHSPEVSHPHPPSPVDPYLLTKNSPPFLKSDHPVGHISGPEVVGSGFQSSVAVRCMLPSAPSAPIRLPHTAALSQFHMPRASQFAAARIPPNYQGPAIPPASFDAYRHYMAYAASRWPMYPTSQPSNHPVPEPHRIMPITKQATRSRPNLRVIPTVTPDKPKQKESLRGSIPAAQVPVQVSIPSLIRYNPEKISDEKNRASQKQKVIEEREKLKNDREARQKKMYYLRTELERLHKQQGEMLRKKRREKDGHKDPLLVEVSRLQDNIMKDIAELRQEAEEAEKKQSELDKVAQILGINIFDKSQKSLSDSREPTEKPGKAEKSKSPEKVSSFSNSSSNKESKVNNEKFRTKSPKPAESPQSATKQLDQPTAAYEYYDAGNHWCKDCNTICGTMFDFFTHMHNKKHTQTLDPYNRPWASKTQSEAKQDAIKRTDKITVPAKGSEFLVPISGFYCQLCEEFLGDPISGEQHVKGHQHNEKYKKYVDENPLYEERRNLDRQAGLAVVLETERRRQSELKRKLSEKPKEEKKEKKAKAVKEVKEDDKVSEKLEDQLSEGRNSPEKAENKRNTGIKLQLKEEVKKESPTSSSFGKFSWKKPEKEEEKSSLVTPSISKEEILESSKDKEDGKTEAGKAKPIKIKLSGKTVVAHTSPWMPVVTTSTQTKIRPNLPIPSTVLRKSCSATMSKPAPLNTFLSIKSSGTTAKPLPVVKESSADLLLPPDIISKAFGGEEVILKGSPEEKVVLAEKSEPSHLPEQILPPPPPPPPPPPPPPPVIPHPAAPSAAQANAILAPVKSNPVVSQTLSPGFVGPNILNPVLPVAIMASAQPAAIPSDETAPGVSESDRDQTLFSVLVRPPPPLSSVFSEQAKKLEKRNSCLATANAKDLYDIFYSSGGKGAPETKGAPETKLSGGPLANGENSNLSRTKSSDTSSTSPLNSSASQEELHQDEGLVAAPIVSNSEKPIAKTLVALGKWSVVEHVGPKSTGSTYGFLQPLTRLCQSRPYETITPKTDTLAIWTSSSFQSDTSRDISPEKSELDLGEPGPPGVEPPPQLLDIQCKESQKLVEIHLRESVNQDKESQELRKSEDCRESEIETNTELKERVKELSEGIVDEGVSTSIGPHSIDDSNLNHGNRYMWEGEVKQPNLLMIDKEAEQSNKLMTGSETPSKVVIKLSPQACSFTKAKLDSFLSEARSLLNPQDTPVKISAPELLLHSPARSAMCLTGSPQEQGVSVVSEEGLENSAPESASRTSRYRSLKLKRERSKDFQVKKIYELAVWDENKKRPETWESPEKPKTEALELQDVHPELTVTIESKALEDFEATDLKVEELTALGNLGDMPVDFCTTRVSPAHRSPTVLCQKVCEENSVSPIGCNSSDPADFEPIPSFSGFPLDSPKTLVLDFETEGERNSPNPRSVRIPSPNILKTGLTENVDRGLGGLEGTHQALDLLAGGMMPEEVKESSQLDKQESLGLELKTINSAGLGPSPCLPDLVDFVTRTSGVQKDKLCSPLSEPGDPSKCSSLELGPLQLEISNASTTEVAILQVDDDSGDPLNLVKAPVSRSPPREQVIEDNMVPQGMPEQETTVGAIQDHTESSVHN

SEQ ID NO: 16094 - protein, 582 aa, Homo Sapiens
MSESWQQPPQTQPQQPQPPQPQHHAEPPPALAEHTLPPGTAENPLGCAVYGILLQPDPGLQPPQHAPLQAAGEPGPKCGVCGHDLAHLSSPHEHQCLAGHDRSFQCTQCLKIFHQATDLLEHQCVQAEQKPFVCGVCKMGFSLLTSLAQHHSSHSGLVKCSICEKTYKPAEAAEPATTAAPSLPAAPAPSTVTPAEQADKPYSCPICQKPFKHLSELSRHERIHTGEKPYKCTLCDKSFSQSSHLVHHKRTHSSERPYKCAVCEKTFKHRSHLVRHMYAHSGEHHLFRCNVCELHFKESSELLQHPCTPSGERPFRCGECQKAFKRPSDLRQHERTHSAERPFKCDLCPMGFKQQYALMRHRRTHKTEEPFKCGLCEKGFGQPSHLLYHQHVHTLETLFKCPVCQKGFDQSAELLRHKCLPGAAERPFKCPVCNKAYKRASALQKHQLAHCAAAEKPLRCTLCERRFFSSSEFVQHRCDPAREKPLKCPDCEKRFKYASDLQRHRRVHTGEKPYKCPNCDKAFKQREHLNKHQGVHAREQQFKCVWCGERFLDVALLQEHSAQHSAAAAAAEGAYQVAACLP

SEQ ID NO: 16095 - protein, 273 aa, Homo Sapiens
MFGFPTATLLDCHGRYAQNVAFFNVMTEAHHKYDHSEATGSSSWDIQNSFRREKLEQKSPDSKTLQEDSPGVRQRVYECQECGKSFRQKGSLTLHERIHTGQKPFECTHCGKSFRAKGNLVTHQRIHTGEKPYQCKECGKSFSQRGSLAVHERLHTGQKPYECAICQRSFRNQSNLAVHRRVHSGEKPYRCDQCGKAFSQKGSLIVHIRVHTGLKPYACTQCRKSFHTRGNCILHGKIHTGETPYLCGQCGKSFTQRGSLAVHQRSCSQRLTL

SEQ ID NO: 16096 - protein, 509 aa, Homo Sapiens
MALSQGLLTFRDVAIEFSQEEWKCLDPAQRTLYRDVMLENYRNLVSLDISSKCMMNTLSSTGQGNTEVIHTGTLQRQASYHIGAFCSQEIEKDIHDFVFQWQEDETNDHEAPMTEIKKLTSSTDRYDQRHAGNKPIKGQLESRFHLHLRRHRRIHTGEKPYKCEECEKVFSCKSHLEIHRIIHTGEKPYKCKVCDKAFKHDSHLAKHTRIHRGDKHYTCNECGKVFDQKATLACHHRSHTGEKPYKCNECGKTFSQTSHLVYHHRLHTGEKPYKCNECGKTFARNSVLVIHKAVHTAEKPYKCNECGKVFKQRATLAGHRRVHTGEKPYRCEECDKVFSRKSHLERHRRIHTGEKPYKCKVCDKAFRSDSRLAEHQRVHTGERPYTCNECGKVFSTKAYLACHQKLHTGEKLYECEECDKVYIRKSHLERHRRIHTGEKPHKCGDCGKAFNSPSHLIRHQRIHTGQKSYKCHQCGKVFSLRSLLAEHQKIPFGDNCFKCNEYSKPSSIN

SEQ ID NO: 16097 - protein, 402 aa, Homo Sapiens
MYTSEEKCNQRTQKRKIYNVCPRKGKKIFIHMHEIIQIDGHIYQCLECKQNFCENLALIMCERTHTGEKPYKCDMCEKTFVQSSDLTSHQRIHNYEKPYKCSKCEKSFWHHLALSGHQRTHAGKKFYTCDICGKNFGQSSDLLVHQRSHTGEKPYLCSECDKCFSRSTNLIRHRRTHTGEKPFKCLECEKAFSGKSDLISHQRTHTGERPYKCNKCEKSYRHRSAFIVHKRVHTGEKPYKCGACEKCFGQKSDLIVHQRVHTGEKPYKCLECMRSFTRSANLIRHQATHTHTFKCLEYEKSFNCSSDLIVHQRIHMEEKPHQWSACESGFLLGMDFVAQQKMRTQTEELHYKYTVCDKSFHQSSALLQHQTVHIGEKPFVCNVSEKGLELSPPHASEASQMS

SEQ ID NO: 16098 - protein, 553 aa, Homo Sapiens
MAFEDVAVYFSQEEWGLLDTAQRALYRRVMLDNFALVASLGLSTSRPRVVIQLERGEEPWVPSGTDTTLSRTTYRRRNPGSWSLTEDRDVSGEWPRAFPDTPPGMTTSVFPVAGACHSVKSLQRQRGASPSRERKPTGVSVIYWERLLLGSGSGQASVSLRLTSPLRPPEGVRLREKTLTEHALLGRQPRTPERQKPCAQEVPGRTFGSAQDLEAAGGRGHHRMGAVWQEPHRLLGGQEPSTWDELGEALHAGEKSFECRACSKVFVKSSDLLKHLRTHTGERPYECAQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFKHQRVHTGEKPFACPQCGRAFSHSSNLTQHQLLHTGERPFRCVDCGKAFAKGAVLLSHRRIHTGEKPFVCTQCGRAFRERPALFHHQRIHTGEKTVRRSRASLHPQARSVAGASSEGAPAKETEPTPASGPAAVSQPAEV

SEQ ID NO: 16099 - protein, 544 aa, Homo Sapiens
MTFEDVAVYFSQEEWGLLDTAQRALYRHVMLENFTLVTSLGLSTSRPRVVIQLERGEEPWVPSGKDMTLARNTYGRLNSGSWSLTEDRDVSGEWPRAFPDTPPGMTTSVFPVADACHSVKSLQRQPGASPSQERKPTGVSVIYWERLLLGSRSDQASISLRLTSPLRPPKSSRPREKTFTEYRVPGRQPRTPERQKPCAQEVPGRAFGNASDLKAASGGRDRRMGAAWQEPHRLLGGQEPSTWDELGEALHAGEKSFECRACSKVFVKSSDLLKHLRTHTGERPYECTQCGKAFSQTSHLTQHQRIHSGETPYACPVCGKAFRHSSSLVRHQRIHTAEKSFRCSECGKAFSHGSNLSQHRKIHAGGRPYACAQCGRRFCRNSHLIQHERTHTGEKPFVCALCGAAFSQGSSLFLHQRVHTGEKPFACAQCGRSFSRSSNLTQHQLLHTGERPFRCVDCGKGFAKGAVLLSHRRIHTGEKPFVCTQCGRAFRERPALLHHQRIHTTEKTNAAAPDCTPGPGFLQGHHRKVRRGGKPSPVLKPAKV

SEQ ID NO: 16100 - protein, 582 aa, Homo Sapiens
MDFEDDYTHSACRNTYQGFNGMDRDYGPGSYGGMDRDYGHGSYGGQRSMDSYLNQSYGMDNHSGGGGGSRFGPYESYDSRSSLGGRDLYRSGYGFNEPEQSRFGGSYGGRFESSYRNSLDSFGGRNQGGSSWEAPYSRSKLRPGFMEDRGRENYSSYSSFSSPHMKPAPVGSRGRGTPAYPESTFGSRNYDAFGGPSTGRGRGRGHMGDFGSIHRPGIVVDYQNKSTNVTVAAARGIKRKMMQPFNKPSGTFIKKPKLAKPMEKISLSKSPTKTDPKNEEEEKRRIEARREKQRRRREKNSEKYGDGYRMAFTCSFCKFRTFEEKDIELHLESSSHQETLDHIQKQTKFDKVVMEFLHECMVNKFKKTSIRKQQTNNQTEVVKIIEKDVMEGVTVDDHMMKVETVHCSACSVYIPALHSSVQQHLKSPDHIKGKQAYKEQIKRESVLTATSILNNPIVKARYERFVKGENPFEIQDHSQDQQIEGDEEDEEKIDEPIEEEEDEDEEEEAEEVGEVEEVEEVEEVREGGIEGEGNIQGVGEGGEVGVVGEVEGVGEVEEVEELEEETAKEEPADFPVEQPEEN

SEQ ID NO: 16101 - protein, 541 aa, Homo Sapiens
MRLKMTTRNFPEREVPCDVEVERFTREVPCLSSLGDGWDCENQEGHLRQSALTLEKPGTQEAICEYPGFGEHLIASSDLPPSQRVLATNGFHAPDSNVSGLDCDPALPSYPKSYADKRTGDSDACGKGFNHSMEVIHGRNPVREKPYKYPESVKSFNHFTSLGHQKIMKRGKKSYEGKNFENIFTLSSSLNENQRNLPGEKQYRCTECGKCFKRNSSLVLHHRTHTGEKPYTCNECGKSFSKNYNLIVHQRIHTGEKPYECSKCGKAFSDGSALTQHQRIHTGEKPYECLECGKTFNRNSSLILHQRTHTGEKPYRCNECGKPFTDISHLTVHLRIHTGEKPYECSKCGKAFRDGSYLTQHERTHTGEKPFECAECGKSFNRNSHLIVHQKIHSGEKPYECKECGKTFIESAYLIRHQRIHTGEKPYGCNQCQKLFRNIAGLIRHQRTHTGEKPYECNQCGKAFRDSSCLTKHQRIHTKETPYQCPECGKSFKQNSHLAVHQRLHSREGPSRCPQCGKMFQKSSSLVRHQRAHLGEQPMET

SEQ ID NO: 16102 - protein, 463 aa, Homo Sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQHQKIHTGEKPYECKDCGKAFRWGSSLVIHKRIHTGEKPYECKDCGKAFRRGDELTQHQRFHTGEKDYECKDCGKTFSRVYKLIQHKRIHSGEKPYECKDCGKAFICGSSLIQHKRIHTGEKPYECQECGKAFTRVNYLTQHQKIHTGEKPHECKECGKAFRWGSSLVKHERIHTGEKPYKCTECGKAFNCGYHLTQHERIHTGETPYKCKECGKAFIYGSSLVKHERIHTGVKPYGCTECGKSFSHGHQLTQHQKTHSGAKSYECKECGKACNHLNHLREHQRIHNS

SEQ ID NO: 16103 - protein, 665 aa, Homo Sapiens
MESVTFEDVAVEFIQEWALLDSARRSLCKYRMLDQCRTLASRGTPPCKPSCVSQLGQRAEPKATERGILRATGVAWESQLKPEELPSMQDLLEEASSRDMQMGPGLFLRMQLVPSIEERETPLTREDRPALQEPPWSLGCTGLKAAMQIQRVVIPVPTLGHRNPWVARDSAVPARDPAWLQEDKVEEEAMAPGLPTACSQEPVTFADVAVVFTPEEWVFLDSTQRSLYRDVMLENYRNLASVADQLCKPNALSYLEERGEQWTTDRGVLSDTCAEPQCQPQEAIPSQDTFTEILSIDVKGEQPQPGEKLYKYNELEKPFNSIEPLFQYQRIHAGEASCECQEIRNSFFQSAHLIVPEKIRSGDKSYACNKCEKSFRYSSDLIRHEKTHTAEKCFDCQECGQAFKYSSNLRRHMRTHTGEKPFECSQCGKTFTRNFNLILHQRNHTGEKPYECKDCGKAFNQPSSLRSHVRTHTGEKPFECSQCGKAFREHSSLKTHLRTHTREKPYECNQCGKPFRTSTHLNVHKRIHTGEKLYECATCGQVLSRLSTLKSHMRTHTGEKPYVCQECGRAFSEPSSLRKHARTHSGKKPYACQECGRAFGQSSHLIVHVRTHSAGRPYQCNQCEKAFRHSSSLTVHKRTHVGRETIRNGSLPLSMSHPYCGPLAN

SEQ ID NO: 16104 - protein, 680 aa, Homo Sapiens
MKMKKFQIPVSFQDLTVNFTQEEWQQLDPAQRLLYRDVMLENYSNLVSVGYHVSKPDVIFKLEQGEEPWIVEEFSNQNYPDIDDALEKNKEIQDKHLTQTVFFSNKTLITERENVFGKTLNLGMNSVPSRKMPYKCNPGGNSLKTNSEVIVAKKSKENRKIPDGYSGFGKHEKSHLGMKKYRYNPMRKASNQNENLILHQNIQILKQPFDYNKCGKTFFKRAILITQKGRQTERKPNECNECRKTFSKRSTLIVHQRIHTGEKPYVCSDCRKTFRVKTSLTRHRRIHTGERPYECSECRKTFIDKSALIVHQKIHGGEKSYECNECGKTFFRKSALAEHFRSHTGEKPYECKECGNAFSKKSYLVVHQRTHRGEKPNECKECGKTFFCQSALTAHQRIHTGEKPYECSECEKTFFCQSALNVHRRSHTGEKPYECSQCGKFLCTKSALIAHQITHRGKKSYECNECGKFFCHKSTLTIHQRTHTGEKHGVFNKCGRISIVKSNCSQCKRMNTKENLYECSEHGHAVSKNSHLIVHQRTIWERPYECNECGRTYCRKSALTHHQRTHTGQRPYECNECGKTFCQKFSFVEHQRTHTGEKPYECNECGKSFCHKSAFRVHRRIHTGEKPYECNQCGKTYRRLWTLTEHQKIHTGEKPYECNKCEKTFRHKSNFLLHQKSHKE

SEQ ID NO: 16105 - protein, 1342 aa, Homo Sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSSTKATLLRHMRERHFRPVAAAAAAAGKKGRLRKWSTSTKSQEEEGPEEEDDDDIVDAGAIDDLEEDSDYNPAEDEPRGRQLRLQRPTPSTPRPRRRPGRPRKLPRLEISDLPDGVEGEPLVSSQSGQSPPEPQDPEAPSSSGPGHLVAMGKVSRTPVEAGVSQSDAENAAPSCPDEHDTLPRRRGRPSRRFLGKKYRKYYYKSPKPLLRPFLCRICGSRFLSHEDLRFHVNSHEAGDPQLFKCLQCSYRSRRWSSLKEHMFNHVGSKPYKCDECSYTSVYRKDVIRHAAVHSRDRKKRPDPTPKLSSFPCPVCGRVYPMQKRLTQHMKTHSTEKPHMCDKCGKSFKKRYTFKMHLLTHIQAVANRRFKCEFCEFVCEDKKALLNHQLSHVSDKPFKCSFCPYRTFREDFLLSHVAVKHTGAKPFACEYCHFSTRHKKNLRLHVRCRHASSFEEWGRRHPEEPPSRRRPFFSLQQIEELKQQHSAAPGPPPSSPGPPEIPPEATTFQSSEAPSLLCSDTLGGATIIYQQGAEESTAMATQTALDLLLNMSAQRELGGTALQVAVVKSEDVEAGLASPGGQPSPEGATPQVVTLHVAEPGGGAAAESQLGPPDLPQITLAPGPFGGTGYSVITAPPMEEGTSAPGTPYSEEPAGEAAQAVVVSDTLKEAGTHYIMATDGTQLHHIELTADGSISFPSPDALASGAKWPLLQCGGLPRDGPEPPSPAKTHCVGDSQSSASSPPATSKALGLAVPPSPPSAATAASKKFSCKICAEAFPGRAEMESHKRAHAGPGAFKCPDCPFSARQWPEVRAHMAQHSSLRPHQCSQCSFASKNKKDLRRHMLTHTKEKPFACHLCGQRFNRNGHLKFHIQRLHSPDGRKSGTPTARAPTQTPTQTIILNSDDETLATLHTALQSSHGVLGPERLQQALSQEHIIVAQEQTVTNQEEAAYIQEITTADGQTVQHLVTSDNQVQYIISQDGVQHLLPQEYVVVPEGHHIQVQEGQITHIQYEQGAPFLQESQIQYVPVSPGQQLVTQAQLEAAAHSAVTAVADAAMAQAQGLFGTDETVPEHIQQLQHQGIEYDVITLADD

SEQ ID NO: 16106 - protein, 751 aa, Homo Sapiens
MGPQGARRQAFLAFGDVTVDFTQKEWRLLSPAQRALYREVTLENYSHLVSLGILHSKPELIRRLEQGEVPWGEERRRRPGPCAGIYAEHVLRPKNLGLAHQRQQQLQFSDQSFQSDTAEGQEKEKSTKPMAFSSPPLRHAVSSRRRNSVVEIESSQGQRENPTEIDKVLKGIENSRWGAFKCAERGQDFSRKMMVIIHKKAHSRQKLFTCRECHQGFRDESALLLHQNTHTGEKSYVCSVCGRGFSLKANLLRHQRTHSGEKPFLCKVCGRGYTSKSYLTVHERTHTGEKPYECQECGRRFNDKSSYNKHLKAHSGEKPFVCKECGRGYTNKSYFVVHKRIHSGEKPYRCQECGRGFSNKSHLITHQRTHSGEKPFACRQCKQSFSVKGSLLRHQRTHSGEKPFVCKDCERSFSQKSTLVYHQRTHSGEKPFVCRECGQGFIQKSTLVKHQITHSEEKPFVCKDCGRGFIQKSTFTLHQRTHSEEKPYGCRECGRRFRDKSSYNKHLRAHLGEKRFFCRDCGRGFTLKPNLTIHQRTHSGEKPFMCKQCEKSFSLKANLLRHQWTHSGERPFNCKDCGRGFILKSTLLFHQKTHSGEKPFICSECGQGFIWKSNLVKHQLAHSGKQPFVCKECGRGFNWKGNLLTHQRTHSGEKPFVCNVCGQGFSWKRSLTRHHWRIHSKEKPFVCQECKRGYTSKSDLTVHERIHTGERPYECQECGRKFSNKSYYSKHLKRHLREKRFCTGSVGEASS

SEQ ID NO: 16107 - protein, 810 aa, Homo Sapiens
MNKVEQKSQESVSFKDVTVGFTQEEWQHLDPSQRALYRDVMLENYSNLVSVGYCVHKPEVIFRLQQGEEPWKQEEEFPSQSFPVWTADHLKERSQENQSKHLWEVVFINNEMLTKEQGDVIGIPFNVDVSSFPSRKMFCQCDSCGMSFNTVSELVISKINYLGKKSDEFNACGKLLLNIKHDETHTQEKNEVLKNRNTLSHHEETLQHEKIQTLEHNFEYSICQETLLEKAVFNTQKRENAEENNCDYNEFGRTLCDSSSLLFHQISPSRDNHYEFSDCEKFLCVKSTLSKPHGVSMKHYDCGESGNNFRRKLCLSHLQKGDKGEKHFECNECGKAFWEKSHLTRHQRVHTGQKPFQCNECEKAFWDKSNLTKHQRSHTGEKPFECNECGKAFSHKSALTLHQRTHTGEKPYQCNACGKTFCQKSDLTKHQRTHTGLKPYECYECGKSFRVTSHLKVHQRTHTGEKPFECLECGKSFSEKSNLTQHQRIHIGDKSYECNACGKTFYHKSLLTRHQIIHTGWKPYECYECGKTFCLKSDLTVHQRTHTGQKPFACPECGKFFSHKSTLSQHYRTHTGEKPYECHECGKIFYNKSYLTKHNRTHTGEKPYECNECGKAFYQKSQLTQHQRIHIGEKPYKCNECGKAFCHKSALIVHQRTHTQEKPYKCNECGKSFCVKSGLIFHERKHTGEKPYECNECGKFFRHKSSLTVHHRAHTGEKSCQCNECGKIFYRKSELAQHQRSHTGEKPYECNTCRKTFSQKSNLIVHQRRHIGENLMNEMDIRNFQPQVSLHNASEYSHCGESPDDILNVQ

SEQ ID NO: 16108 - protein, 778 aa, Homo Sapiens
MNKVDQKFQGSVSFKDVTVGFTQEEWQHLDPSQRALYRDVMLENYSNLVSVGYCAHKPEVIFRLEQGEEPWRLEEEFPSQSFPEVWTADHLKERSQENQSKHLWEVVFINNEMLTKEQGNVIGIPFNMDVSSFPSRKMFCQYDSRGMSFNTVSELVISKINYLGKKSDEFNACGKLLLNIKHDETHTREKNEVLKNRNTLSHRENTLQHEKIQTLDHNFEYSICQETLLEKAVFNTRKRENAEENNCDYNEFGRTFCDSSSLLFHQIPPSKDSHYEFSDCEKFLCVKSTLSKHDGVPVKHYDCGESGNNFRRKLCLSQLQKGDKGEKHFECNECGKAFWEKSHLTRHQRVHTGEKHFQCNQCGKTFWEKSNLTKHQRSHTGEKPFECNECGKAFSHKSALTLHQRTHTGEKPYQCNACGKTFYQKSDLTKHQRTHTGQKPYECYECGKSFCMNSHLTVHQRTHTGEKPFECLECGKSFCQKSHLTQHQRTHIGDKPYECNACGKTFYHKSVLTRHQIIHTGLKPYECYECGKTFCLKSDLTIHQRTHTGEKPFACPECGKFFSHKSTLSQHYRTHTGEKPYECHECGKIFYNKSYLTKHNRTHTGEKPYECNECGKTFCQKSQLTQHQRIHIGEKPYECNECGKAFCHKSALIVHQRTHTQEKPYKCNECGKSFCVKSGLILHERKHTGEKPYECNECGKSFSHKSSLTVHHRAHTGEKSCQCNECGKIFYRKSDLAKHQRSHTGEKPYECNTCRKTFSQKSNLIVHQRTHIGEKPYE

SEQ ID NO: 16109 - protein, 560 aa, Homo Sapiens; identical to SEQ ID NO: 14410

SEQ ID NO: 16110 - protein, 854 aa, Homo Sapiens
MAQAIFEALEGMDNQTVLAVQSLLDGQGAVPDPTGQSVNAPPAIQPLDDEDVFLCGKCKKQFNSLPAFMTHKREQCQGNAPALATVSLATNSIYPPSAAPTAVQQAPTPANRQISTYITVPPSPLIQTLVQGNILVSDDVLMSAMSAFTSLDQPMPQGPPPVQSSLNMHSVPSYLTQPPPPPPPPPPLPPPPPPQPPPPPPQSLGPPGRPNPGGNGVVEVYSAAAPLAGSGTVEIQALGMQPYPPLEVPNQCVEPPVYPTPTVYSPGKQGFKPKGPNPAAPMTSATGGTVATFDSPATLKTRRAKGARGLPEAAGKPKAQKLKCSYCDKSFTKNFDLQQHIRSHTGEKPFQCIACGRAFAQKSNVKKHMQTHKVWPPGHSGGTVSRNSVTVQVMALNPSRQEDEESTGLGQPLPGAPQPQALSTAGEEEGDKPESKQVVLIDSSYLCQFCPSKFSTYFQLKSHMTQHKNEQVYKCVVKSCAQTFPKLDTFLEHIKSHQEELSYRCHLCGKDFPSLYDLGVHQYSHSLLPQHSPKKDNAVYKCVKCVNKYSTPEALEHHLQTATHNFPCPHCQKVFPCERYLRRHLPTHGSGGRFKCQVCKKFFRREHYLKLHAHIHSGEKPYKCSVCESAFNRKDKLKRHMLIHEPFKKYKCPFSTHTGCSKEFNRPDKLKAHILSHSGMKLHKCALCSKSFSRRAHLAEHQRAHTGNYKFRCAGCAKGFSRHKYLKDHRCRLGPQKDKDLQTRRPPQRRAAPRSCGSGGRKVLTPLPDPLGLEELKDTGAGLVPEAVPGKPPFAEPDAVLSIVVGGAVGAETELVVPGHAEGLGSNLALAELQAGAEGPCAMLAVPVYIQASE

SEQ ID NO: 16111 - protein, 599 aa, Homo Sapiens
MMLPYPSALGDQYWEEILLPKNGENVETMKKLTQNHKAKGLPSNDTDCPQKKEGKAQIVVPVTFRDVTVIFTEAEWKRLSPEQRNLYKEVMLENYRNLLSLAEPKPEIYTCSSCLLAFSCQQFLSQHVLQIFLGLCAENHFHPGNSSPGHWKQQGQQYSHVSCWFENAEGQERGGGSKPWSARTEERETSRAFPSPLQRQSASPRKGNMVVETEPSSAQRPNPVQLDKGLKELETLRFGAINCREYEPDHNLESNFITNPRTLLGKKPYICSDCGRSFKDRSTLIRHHRIHSMEKPYVCSECGRGFSQKSNLSRHQRTHSEEKPYLCRECGQSFRSKSILNRHQWTHSEEKPYVCSECGRGFSEKSSFIRHQRTHSGEKPYVCLECGRSFCDKSTLRKHQRIHSGEKPYVCRECGRGFSQNSDLIKHQRTHLDEKPYVCRECGRGFCDKSTLIIHERTHSGEKPYVCGECGRGFSRKSLLLVHQRTHSGEKHYVCRECRRGFSQKSNLIRHQRTHSNEKPYICRECGRGFCDKSTLIVHERTHSGEKPYVCSECGRGFSRKSLLLVHQRTHSGEKHYVCRECGRGFSHKSNLIRHQRTH

SEQ ID NO: 16112 - protein, 488 aa, Homo Sapiens
MENLTKHSIECSSFRGDWECKNQFERKQGSQEGHFSEMIFTPEDMPTFSIQHQRIHTDEKLLECKECGKDFSFVSVLVRHQRIHTGEKPYECKECGKAFGSGANLAYHQRIHTGEKPFECKECGKAFGSGSNLTHHQRIHTGEKPYECKECGKAFSFGSGLIRHQIIHSGEKPYECKECGKSFSFESALIRHHRIHTGEKPYECIDCGKAFGSGSNLTQHRRIHTGEKPYECKACGMAFSSGSALTRHQRIHTGEKPYICNECGKAFSFGSALTRHQRIHTGEKPYVCKECGKAFNSGSDLTQHQRIHTGEKPYECKECEKAFRSGSKLIQHQRMHTGEKPYECKECGKTFSSGSDLTQHHRIHTGEKPYECKECGKAFGSGSKLIQHQLIHTGERPYECKECGKSFSSGSALNRHQRIHTGEKPYECKECGKAFYSGSSLTQHQRIHTGEKLYECKNCGKAYGRDSEFQQHKKSHNGKKLCELETIN

SEQ ID NO: 16113 - protein, 294 aa, Homo Sapiens
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQAHVSGFKHKNQSPKTVASSLGQIPMQRQPIQKDSTTLED

SEQ ID NO: 16114 - protein, 839 aa, Homo Sapiens
MALTQGQVTFRDVAIEFSQEEWTCLDPAQRTLYRDVMLENYRNLASLGISCFDLSIISMLEQGKEPFTLESQVQIAGNPDGWEWIKAVITALSSEFVMKDLLHKGKSNTGEVFQTVMLERQESQDIEGCSFREVQKNTHGLEYQCRDAEGNYKGVLLTQEGNLTHGRDEHDKRDARNKLIKNQLGLSLQSHLPELQLFQYEGKIYECNQVEKSFNNNSSVSPPQQMPYNVKTHISKKYLKDFISSLLLTQGQKANNWGSPYKSNGCGMVFPQNSHLASHQRSHTKEKPYKCYECGKAFRTRSNLTTHQVIHTGEKRYKCNECGKVFSRNSQLSQHQKIHTGEKPYKCNECGKVFTQNSHLVRHRGIHTGEKPYKCNECGKAFRARSSLAIHQATHSGEKPYKCNECGKVFTQNSHLTNHWRIHTGEKPYKCNECGKAFGVRSSLAIHLVIHTGEKPYKCHECGKVFRRNSHLARHQLIHTGEKPYKCNECGKAFRAHSNLTTHQVIHTGEKPYKCNECGKVFTQNSHLANHQRIHTGVKPYMCNECGKAFSVYSSLTTHQVIHTGEKPYKCNECGKVFTQNSHLARHRGIHTGEKPYKCNECGKVFRHNSYLSRHQRIHTGEKPYKYNEYGKAFSEHSNLTTHQVIHTGEKPYKCNECGKVFTQNSHLARHRRVHTGGKPYQCNECGKAFSQTSKLARHQRVHTGEKPYECNQCGKAFSVRSSLTTHQAIHTGKKPYKCNECGKVFTQNSHLARHRGIHTGEKPYKCNECGKAFSQTSKLARHQRIHTGEKPYECGKPFSICSSLTTHQTIHTGGKPYKCNVWKVLKSEFKPCKPSQNS

SEQ ID NO: 16115 - protein, 527 aa, Homo Sapiens
MTAELREAMALAPWGPVKVKKEEEEEENFPGQASSQQVHSENIKVWAPVQGLQTGLDGSEEEEKGQNISWDMAVVLKATQEAPAASTLGSYSLPGTLAKSEILETHGTMNFLGAETKNLQLLVPKTEICEEAEKPLIISERIQKADPQGPELGEACEKGNMLKRQRIKREKKDFRQVIVNDCHLPESFKEEENQKCKKSGGKYSLNSGAVKNPKTQLGQKPFTCSVCGKGFSQSANLVVHQRIHTGEKPFECHECGKAFIQSANLVVHQRIHTGQKPYVCSKCGKAFTQSSNLTVHQKIHSLEKTFKCNECEKAFSYSSQLARHQKVHITEKCYECNECGKTFTRSSNLIVHQRIHTGEKPFACNDCGKAFTQSANLIVHQRSHTGEKPYECKECGKAFSCFSHLIVHQRIHTAEKPYDCSECGKAFSQLSCLIVHQRIHSGDLPYVCNECGKAFTCSSYLLIHQRIHNGEKPYTCNECGKAFRQRSSLTVHQRTHTGEKPYECEKCGAAFISNSHLMRHHRTHLVE

SEQ ID NO: 16116 - protein, 532 aa, Homo Sapiens
MIQAQESITLEDVAVDFTWEEWQLLGAAQKDLYRDVMLENYSNLVAVGYQASKPDALFKLEQGEQLWTIEDGIHSGACSDIWKVDHVLERLQSESLVNRRKPCHEHDAFENIVHCSKSQFLLGQNHDIFDLRGKSLKSNLTLVNQSKGYEIKNSVEFTGNGDSFLHANHERLHTAIKFPASQKLISTKSQFISPKHQKTRKLEKHHVCSECGKAFIKKSWLTDHQVMHTGEKPHRCSLCEKAFSRKFMLTEHQRTHTGEKPYECPECGKAFLKKSRLNIHQKTHTGEKPYICSECGKGFIQKGNLIVHQRIHTGEKPYICNECGKGFIQKTCLIAHQRFHTGKTPFVCSECGKSCSQKSGLIKHQRIHTGEKPFECSECGKAFSTKQKLIVHQRTHTGERPYGCNECGKAFAYMSCLVKHKRIHTREKQEAAKVENPPAERHSSLHTSDVMQEKNSANGATTQVPSVAPQTSLNISGLLANRNVVLVGQPVVRCAASGDNRGFAQDRNLVNAVNVVVPSVINYVLFYVTENP

SEQ ID NO: 16117 - protein, 605 aa, Homo Sapiens
MAAGQREARPQVSLTFEDVAVLFTRDEWRKLAPSQRNLYRDVMLENYRNLVSLGLPFTKPKVISLLQQGEDPWEVEKDGSGVSSLGSKSSHKTTKSTQTQDSSFQGLILKRSNRNVPWDLKLEKPYIYEGRLEKKQDKKGSFQIVSATHKKIPTIERSHKNTELSQNFSPKSVLIRQQILPREKTPPKCEIQGNSLKQNSQLLNQPKITADKRYKCSLCEKTFINTSSLRKHEKNHSGEKLFKCKECSKAFSQSSALIQHQITHTGEKPYICKECGKAFTLSTSLYKHLRTHTVEKSYRCKECGKSFSRRSGLFIHQKIHAEENPCKYNPGRKASSCSTSLSGCQRIHSRKKSYLCNECGNTFKSSSSLRYHQRIHTGEKPFKCSECGRAFSQSASLIQHERIHTGEKPYRCNECGKGFTSISRLNRHRIIHTGEKFYNCNECGKALSSHSTLIIHERIHTGEKPCKCKVCGKAFRQSSALIQHQRMHTGERPYKCNECGKTFRCNSSLSNHQRIHTGEKPYRCEECGISFGQSSALIQHRRIHTGEKPFKCNTCGKTFRQSSSRIAHQRIHTGEKPYECNTCGKLFNHRSSLTNHYKIHIEEDP

SEQ ID NO: 16118 - protein, 612 aa, Homo Sapiens
MAAGQREARPQVSLTFEDVAVLFTWDEWRKLAPSQRNLYRDVMLENYRNLVSLGLSFTKPKVISLLQQGEDPWEVEKDSSGVSSLGCKSTPKMTKSTQTQDSFQEQIRKRLKRDEPWNFISERSCIYEEKLKKQQDKNENLQIISVAHTKILTVDRSHKNVEFGQNFYLKSVFIKQQRFAKEKTPSKCEIQRNSFKQNSNLLNQSKIKTAEKRYKCSTCEKAFIHNSSLRKHQKNHTGEKLFKCKECLKAFSQSSALIQHQRTHTGEKPYICKECGKAFSHSASLCKHLRTHTVEKCYRCKECGKSFSRRSGLFIHQKIHAQENPHKYNPGRKASSYSTSLSGSQKIHLRKKSYLCNECGNTFKSSSSLRYHQRIHTGEKPFKCSECGRAFSQSASLIQHERIHTGEKPYRCNECGKGFTSISRLNRHRIIHTGEKLYNCNECGKALSSHSTLIIHERIHTGEKPCKCKVCGKAFRQSSALIQHQRMHTGERPYKCNECDKTFRCNSSLSNHQRIHTGEKPYRCLECGMSFGQSAALIQHQRIHTGEKPFKCNTCGKTFRQSSSLIAHQRIHTGEKPYECNACGKLFSQRSSLTNHYKIHIEEDSLKADLHV

SEQ ID NO: 16119 - protein, 554 aa, Homo Sapiens [sequence omitted]

SEQ ID NO: 16120 - protein, 428 aa, Homo Sapiens
MRDEVAEKEKADINVTLVFQGYENTPIMVCVDGIVFSKPDLVTCLEQRKKPWSMKHPGLTQHNIVHTGDKPYKCKDCGKIFKWSSNLTIHQRIHSGEKPYKCEECGKAFKQSSKLNEHMRAHTGEKFYKCEECGKAFKHPSGLTLHKRIHTGENPYKFEECDKAFYWVLSFTKHMIIHRGEKPYKYQECGKAFKWSSNLTIHKRIHTGEKPCKCEECGKACKQSLGLTIQKRIHTEEKPYKCEECGSSNLTIYKKIHAGEKPYNCEKCGKAFYCSSNLIQNNIVHAEEKHYKCQECGKAFKKSLDLNVHKIIHSGEKPYRYEECGKITHSGEESYKCEECGKGFYCSSSLTKHMIVHTEEKLYKCEECGKAFKWSSELTIHQRIRTEEKPYKCEECVRVFKHSSKLNEHKRNHTGEKPYKCEACGKAF

SEQ ID NO: 16121 - protein, 568 aa, Homo Sapiens
MRRSVLVRNPGHKGLRPVYEELDSDSEDLDPNPEDLDPVSEDPEPDPEDLNTVPEDVDPSYEDLEPVSEDLDPDAEAPGSEPQDPDPMSSSFDLDPDVIGPVPLILDPNSDTLSPGDPKVDPISSGLTATPQVLATSPAVLPAPASPPRPFSCPDCGRAFRRSSGLSQHRRTHSGEKPYRCPDCGKSFSHGATLAQHRGIHTGARPYQCAACGKAFGWRSTLLKHRSSHSGEKPHHCPVCGKAFGHGSLLAQHLRTHGGPRPHKCPVCAKGFGQGSALLKHLRTHTGERPYPCPQCGKAFGQSSALLQHQRTHTAERPYRCPHCGKAFGQSSNLQHHLRIHTGERPYACPHCSKAFGQSSALLQHLHVHSGERPYRCQLCGKAFGQASSLTKHKRVHEGAAAAAAAAAAAAAAAAAGLGLGPGLSPASMMRPGQVSLLGPDAVSVLGSGLGLSPGTSSGRNPDPGSGPGTLPDPSSKPLPGSRSTPSPTPVESSDPKAGHDAGPDLVPSPDLDPVPSPDPDPVPSPDPNPVSCPDPCSPTRGTVSPALPTGESPEWVQEQGALLGPDG

SEQ ID NO: 16122 - protein, 420 aa, Homo Sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPHKCPHCSKSFANASYLAQHLRIHLGVKPYHCSYCDKSFRQLSHLQQHTRIHTGDRPYKCPHPGCEKAFTQLSNLQSHQRQHNKDKPYKCPNCYRAYSDSASLQIHLSAHAIKHAKAYCCSMCGRAYTSETYLMKHMSKHTVVEHLVSHHSPQRTESPGIPVRISLI

SEQ ID NO: 16123 - protein, 216 aa, Homo Sapiens
MSALGQITITVSRCWNTERNQTDKNPCLHGAYLQLRETVKNKSTHLKKPLMKQAPPWKDHLTFQPLHPAERKTQVWRWQSGNSSDLETTSSASPWPTGSNRDVVLNTLAESCCGLSELITAPPYAGVSIQGFSQIWVLFPFCGGTFHHNEKDVLGLQDFERESVSTSQSRNISLLTLGQLQNCVIGKLTIIDLLTEHLLGVRHGVICFPWGLPSSS

SEQ ID NO: 16124 - protein, 407 aa, Homo Sapiens
MQQKAFEESRYPWQESFENVAVCLPLRCPRCGDHTRFRSLSSLRAHLEFSHSYEERTLLTKCSLFPSLKDTDLVTSSELLKPGKLQSSGNVVKQKPSYVNLYSISHEHSKDRKPFEVVAERPVSYVQTYTAMDLHADSLDGTRSGPGLPTSDTKASFEAHVREKFNRMVEAVDRTIEKRIDKLTKELAQKTAELLEVRAAFVQLTQKKQEVQRRERALNRQVDVAVEMIAVLRQRLTESEEELLRKEEEVVTFNHFLEAAAEKEVQGKARLQDFIENLLQRVELAEKQLEYYQSQQASGFVRDLSGHVLTDISSNRKPKCLSRGHPHSVCNHPDLKAHFHPKGRNHLKKAKDDRASMQPAKAIHEQAESSRDLCRPPKKGELLGFGRKGNIRPKMAKKKPTAIVNII

SEQ ID NO: 16125 - protein, 744 aa, Homo Sapiens
MQKEMKMIKDEDVHFDLAVKKTPSFPHCLQPVASRGKAPQRHPFPEALRGPFSQFRYEPPPGDLDGFPGVFEGAGSRKRKSMPTKMPYNHPAEEVTLALHSEENKNHGLPNLPLLFPQPPRPKYDSQMIDLCNVGFQFYRSLEHFGGKPVKQEPIKPSAVWPQPTPTPFLPTPYPYYPKVHPGLMFPFFVPSSSPFPFSRHTFLPKQPPEPLLPRKAEPQESEETKQKVERVDVNVQIDDSYYVDVGGSQKRWQCPTCEKSYTSKYNLVTHILGHSGIKPHACTHCGKLFKQLSHLHTHMLTHQGTRPHKCQVCHKAFTQTSHLKRHMMQHSEVKPHNCRVCGRGFAYPSELKAHEAKHASGRENICVECGLDFPTLAQLKRHLTTHRGPIQYNCSECDKTFQYPSQLQNHMMKHKDIRPYICSECGMEFVQPHHLKQHSLTHKGVKEHKCGICGREFTLLANMKRHVLIHTNIRAYQCHLCYKSFVQKQTLKAHMIVHSDVKPFKCKLCGKEFNRMHNLMGHMHLHSDSKPFKCLYCPSKFTLKGNLTRHMKVKHGVMERGLHSQGLGRGRIALAQTAGVLRSLEQEEPFDLSQKRRAKVPVFQSDGESAQGSHCHEEEEEDNCYEVEPYSPGLAPQSQQLCTPEDLSTKSEHAPEVLEEACKEEKEDASKGEWEKRSKGDLGAEGGQERDCAGRDECLSLRAFQSTRRGPSFSDYLYFKHRDESLKELLERKMEKQAVLLGI

SEQ ID NO: 16126 - protein, 350 aa, Homo Sapiens
MIRGFEAPMAENPPPPPPPVIFCHDSPKRVLVSVIRTTPIKPTCGGGGEPEPPPPLIPTSPGFSDFMVYPWRWGENAHNVTLSPGAAGAAASAALPAAAAAEHSGLRGRGAPPPAASASAAASGGEDEEEASSPDSGHLKDGIRRGRPRADTVRDLINEGEHSSSRIRCNICNRVFPREKSLQAHKRTHTGERPYLCDYPDCGKAFVQSGQLKTHQRLHTGEKPFVCSENGCLSRFTHANRHCPKHPYARLKREEPTDTLSKHQAADNKAAAEWLARYWEMREQRTPTLKGKLVQKADQEQQDPLEYLQSDEEDDEKRGAQRRLQEQRERLHGALALIELANLTGAPLRQ

SEQ ID NO: 16127 - protein, 561 aa, Homo Sapiens
MITSQGSVSFRDVTVGFTQEEWQHLDPAQRTLYRDVMLENYSHLVSVGYCIPKPEVILKLEKGEEPWILEEKFPSQSHLELINTSRNYSIMKFNEFNKGGKCFCDEKHEIIHSEEEPSEYNKNGNSFWLNEDLIWHQKIKNWEQSFEYNECGKAFPENSLFLVHKRGYTGQKTCKYTEHGKTCDMSFFITHQQTHPRENHYGNECGENIFEESILLEHQSVYPFSQKLNLTPIQRTHSINNIIEYNECGTFFSEKLVLHLQQRTHTGEKPYECHECGKTFTQKSAHTRHQRTHTGGKPYECHECGKTFYKNSDLIKHQRIHTGERPYGCHECGKSFSEKSTLTQHQRTHTGEKPYECHECGKTFSFKSVLTVHQKTHTGEKPYECYACGKAFLRKSDLIKHQRIHTGEKPYECNECGKSFSEKSTLTKHLRTHTGEKPYECIQCGKFFCYYSGFTEHLRRHTGEKPFGCNECGKTFRQKSALIVHQRTHIRQKPYGCNQCGKSFCVKSKLIAHHRTHTGEKPYECNVCGKSFYVKSKLTVHQRIHLGRNPINVVNEGNYSG

SEQ ID NO: 16128 - protein, 550 aa, Homo Sapiens
MPLQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSLSVHPSNLMEKKPSAYNKYGKFLCRKPVFIMPQRPQTEEKPFHCPYCGNNFRRKSYLIEHQRIHTGEKPYVCNQCGKAFRQKTALTLHEKTHIEGKPFICIDCGKSFRQKATLTRHHKTHTGEKAYECPQCGSAFRKKSYLIDHQRTHTGEKPYQCNECGKAFIQKTTLTVHQRTHTGEKPYICNECGKSFCQKTTLTLHQRIHTGEKPYICNECGKSFRQKAILTVHHRIHTGEKSNGCPQCGKAFSRKSNLIRHQKTHTGEKPYECKQCGKFFSCKSNLIVHQKTHKVETTGIQ

SEQ ID NO: 16129 - protein, 475 aa, Homo Sapiens
MAEGSVMFSDVSIDFSQEEWDCLDPVQRDLYRDVMLENYGNLVSMGLYTPKPQVISLLEQGKEPWMVGRELTRGLCSDLESMCETKLLSLKKEVYEIELCQREIMGLTKHGLEYSSFGDVLEYRSHLAKQLGYPNGHFSQEIFTPEYMPTFIQQTFLTLHQIINNEDRPYECKKCGKAFSQNSQFIQHQRIHIGEKSYECKECGKFFSCGSHVTRHLKIHTGEKPFECKECGKAFSCSSYLSQHQRIHTGKKPYECKECGKAFSYCSNLIDHQRIHTGEKPYECKVCGKAFTKSSQLFQHARIHTGEKPYECKECGKAFTQSSKLVQHQRIHTGEKPYECKECGKAFSSGSALTNHQRIHTGEKPYDCKECGKAFTQSSQLRQHQRIHAGEKPFECLECGKAFTQNSQLFQHQRIHTDEKPYECNECGKAFNKCSNLTRHLRIHTGEKPYNCKECGKAFSSGSDLIRHQGIHTNK

SEQ ID NO: 16130 - protein, 577 aa, Homo Sapiens
MEESHFNSNPYFWPSIPTVSGQIENTMFINKMKDQLLPEKGCGLAPPHYPTLLTVPASVSLPSGISMDTESKSDQLTPHSQASVTQNITVVPVPSTGLMTAGVSCSQRWRREGSQSRGPGLVITSPSGSLVTTASSAQTFPISAPMIVSALPPGSQALQVVPDLSKKVASTLTEEGGGGGGGGGSVAPKPPRGRKKKRMLESGLPEMNDPYVLSPEDDDDHQKDGKTYRCRMCSLTFYSKSEMQIHSKSHTETKPHKCPHCSKTFANSSYLAQHIRIHSGAKPYSCNFCEKSFRQLSHLQQHTRIHSKMHTETIKPHKCPHCSKTFANTSYLAQHLRIHSGAKPYNCSYCQKAFRQLSHLQQHTRIHTGDRPYKCAHPGCEKAFTQLSNLQSHRRQHNKDKPFKCHNCHRAYTDAASLEVHLSTHTVKHAKVYTCTICSRAYTSETYLMKHMRKHNPPDLQQQVQAAAAAAAVAQAQAQAQAQAQAQAQAQAQAQASQASQQQQQQQQQQQQQQQQPPPHFQSPGAAPQGGGGGDSNPNPPPQCSFDLTPYKTAEHHKDICLTVTTSTIQVEHLASS

SEQ ID NO: 16131 - protein, 386 aa, Homo Sapiens
MILGSLSRAGPLPLLRQPPIMQPPLDLKQILPFPLEPAPTLGLFSNYSTMDPVQKAVLSHTFGGPLLKTKRPVISCNICQIRFNSQSQAEAHYKGNRHARRVKGIEAAKTRGREPGVREPGDPAPPGSTPTNGDGVAPRPVSMENGLGPAPGSPEKQPGSPSPPSIPETGQGVTKGEGGTPAPASLPGGSKEEEEKAKRLLYCALCKVAVNSLSQLEAHNKGTKHKTILEARSGLGPIKAYPRLGPPTPGEPEAPAQDRTFHCEICNVKVNSEVQLKQHISSRRHRDGVAGKPNPLLSRHKKSRGAGELAGTLTFSKELPKSLAGGLLPSPLAVAAVMAAAAGSPLSLRPAPAAPLLQGPPITHPLLHPAPGPIRTAHGPILFSPY

SEQ ID NO: 16132 - protein, 471 aa, Homo Sapiens
MNMANFLRGFEEKGIKNDRPEDQLSKEKKKILFSFCEVCNIQLNSAAQAQVHSNGKSHRKRVKQLSDGQPPPPAQASPSSNSSTGSTCHTTTLPALVRTPTLMMQPSLDIKPFMSFPVDSSSAVGLFPNFNTMDPVQKAVINHTFGVSIPPKKKQVISCNVCQLRFNSDSQAEAHYKGSKHAKKVKALDATKNKPKMVPSKDSAKANPSCSITPITGNNSDKSEDKGKLKASSSSQPSSSESGSFLLKSGTTPLPPGAATSPSKSTNGAPGTVVESEEEKAKKLLYCSLCKVAVNSLSQLEAHNTGSKHKTMVEARNGAGPIKSYPRPGSRLKMQNGSKGSGLQNKTFHCEICDVHVNSEIQLKQHISSRRHKDRVAGKPLKPKYSPYNKLQRSPSILAAKLAFQKDMMKPLAPAFLSSPLAAAAAVSSALSLPPRPSASLFQAPAIPPALLRPGHGPIRATPASILFAPY

SEQ ID NO: 16133 - protein, 424 aa, Homo Sapiens
MGLAAGPASGAPSPLLASLPLPTRPLQPPLDFKHLLAFHFNGAAPLSLFPNFSTMDPVQKAVISHTFGVPSPLKKKLFISCNICHLRFNSANQAEAHYKGHKHARKLKAVEAAKSKQRPHTQAQDGAVVSPIPTLASGAPGEPQSKVPAAPPLGPPLQPPPTPDPTCREPAHSELLDAASSSSSSSCPPCSPEPGREAPGPEPAAAAVGSSMSGEGRSEKGHLYCPTCKVTVNSASQLQAHNTGAKHRWMMEGQRGAPRRSRGRPVSRGGAGHKAKRVTGGRGGRQGPSPAFHCALCQLQVNSETQLKQHMSSRRHKDRLAGKTPKPSSQHSKLQKHAALAVSILKSKLALQKQLTKTLAARFLPSPLPTAATAICALPGPLALRPAPTAATTLFPAPILGPALFRTPAGAVRPATGPIVLAPY

SEQ ID NO: 16134 - protein, 395 aa, Homo Sapiens
MRNIMYFGGTCQSPALPALVRPPAPPLQPSLDIKPFLPFPLDTAAAVNLFPNFNAMDPIQKAVINHTFGVPLPHRRKQIISCNICQLRFNSDSQAAAHYKGTKHAKKLKALEAMKNKQKSVTAKDSAKTTFTSITTNTINTSSDKTDGTAGTPAISTTTTVEIRKSSVMTTEITSKVEKSPTTATGNSSCPSTETEEEKAKRLLYCSLCKVAVNSASQLEAHNSGTKHKTMLEARNGSGTIKAFPRAGVKGKGPVNKGNTGLQNKTFHCEICDVHVNSETQLKQHISSRRHKDRAAGKPPKPKYSPYNKLQKTAHPLGVKLVFSKEPSKPLAPRILPNPLAAAAAAAAVAVSSPFSLRTAPAATLFQTSALPPALLRPAPGPIRTAHTPVLFAPY

SEQ ID NO: 16135 - protein, 358 aa, Homo Sapiens
MESLRGNTAQGPTNEEDYKNEGQLSRQTKCPAQKKSSFENTVVRKVSVTLKEIFTGEEGPESSEFSLSPNLDAQQKIPKGHGSPISRKNSKDNSDLIKHQRLFSQRKPCKCNECEKAFSYQSDLLVHSRIHGGEKPFECNKCGKSFSRSTHLIEHQRTHTGEKPYECNECGKAFSRSTHLSLHQRIHTGEKPYECSECGKAFSRSTNLSQHQRTHTQERPYKCNECGKAFGDRSTIIQHQRIHTGENPYECSKCGKAFSWISSLTEHQRTHTGENPYECSECGKVFSRSSSLTEHQRIHSGEKPHECRVCGKGFSRSSSLIIHQRTHTGEKPYKCNDCGKAFCQSSTLIRHQHLHTKE

SEQ ID NO: 16136 - protein, 561 aa, Homo Sapiens
MNSSLTAQRRGSDAELGPWVMAARSKDAAPSQRDGLLPVKVEEDSPGSWEPNYPAASPDPETSRLHFRQLRYQEVAGPEEALSRLRELCRRWLRPELLSKEQILELLVLEQFLTILPEELQAWVREHCPESGEEAVAVVRALQRALDGTSSQGMVTFEDTAVSLTWEEWERLDPARRDFCRESAQKDSGSTVPPSLESRVENKELIPMQQILEEAEPQGQLQEAFQGKRPLFSKCGSTHEDRVEKQSGDPLPLKLENSPEAEGLNSISDVNKNGSIEGEDSKNNELQNSARCSNLVLCQHIPKAERPTDSEEHGNKCKQSFHMVTWHVLKPHKSDSGDSFHHSSLFETQRQLHEERPYKCGNCGKSFKQRSDLFRHQRIHTGEKPYGCQECGKSFSQSAALTKHQRTHTGEKPYTCLKCGERFRQNSHLNRHQSTHSRDKHFKCEECGETCHISNLFRHQRLHKGERPYKCEECEKSFKQRSDLFKHHRIHTGEKPYGCSVCGKRFNQSATLIKHQRIHTGEKPYKCLECGERFRQSTHLIRHQRIHQNKVLSAGRGGSRL

SEQ ID NO: 16137 - protein, 513 aa, Homo Sapiens
MASVLSRRLGKRSLLGARVLGPSASEGPSAAPPSEPLLEGAAPQPFTTSDDTPCQEQPKEVLKAPSTSGLQQVAFQPGQKVYVWYGGQECTGLVEQHSWMEGQVTVWLLEQKLQVCCRVEEVWLAELQGPCPQAPPLEPGAQALAYRPVSRNIDVPKRKSDAVEMDEMMAAMVLTSLSCSPVVQSPPGTEANFSASRAACDPWKESGDISDSGSSTTSGHWSGSSGVSTPSPPHPQASPKYLGDAFGSPQTDHGFETDPDPFLLDEPAPRKRKNSVKVMYKCLWPNCGKVLRSIVGIKRHVKALHLGDTVDSDQFKREEDFYYTEVQLKEESAAAAAAAAAGTPVPGTPTSEPAPTPSMTGLPLSALPPPLHKAQSSGPEHPGPESSLPSGALSKSAPGSFWHIQADHAYQALPSFQIPVSPHIYTSVSWAAAPSAACSLSPVRSRSLSFSEPQQPAPAMKSHLIVTSPPRAQSGARKARGEAKKCRKVYGIEHRDQWCTACRWKKACQRFLD

SEQ ID NO: 16138 - protein, 335 aa, Homo Sapiens
MSAKLGKSSSLLTQTSEECNGILTEKMEEEEQTCDPDSSLHWSSSYSPETFRQQFRQFGYQDSPGPHEALSRLWELCHLWLRPEVHTKEQILELLVLEQFLAILPKELQAWVQKHHPENGEETVTMLEDVERELDGPKQIFFGRRKDMIAEKLAPSEITEELPSSQLMPVKKQLQGASWELQSLRPHDEDIKTTNVKSASRQKTSLGIELHCNVSNILHMNGSQSSTYRGTYEQDGRFEKRQGNPSWKKQQKCDECGKIFSQSSALILHQRIHSGKKPYACDECAKAFSRSAILIQHRRTHTGEKPYKCHDCGKAFSQSSNLFRHRKRHIRKKVP

SEQ ID NO: 16139 - protein, 534 aa, Homo Sapiens
MAVESGVISTLIPQDPPEQELILVKVEDNFSWDEKFKQNGSTQSCQELFRQQFRKFCYQETPGPREALSRLQELCYQWLMPELHTKEQILELLVLEQFLSILPEELQIWVQQHNPESGEEAVTLLEDLEREFDDPGQQVPASPQGPAVPWKDLTCLRASQESTDIHLQPLKTQLKSWKPCLSPKSDCENSETATKEGISEEKSQGLPQEPSFRGISEHESNLVWKQGSATGEKLRSPSQGGSFSQVIFTNKSLGKRDLYDEAERCLILTTDSIMCQKVPPEERPYRCDVCGHSFKQHSSLTQHQRIHTGEKPYKCNQCGKAFSLRSYLIIHQRIHSGEKAYECSECGKAFNQSSALIRHRKIHTGEKACKCNECGKAFSQSSYLIIHQRIHTGEKPYECNECGKTFSQSSKLIRHQRIHTGERPYECNECGKAFRQSSELITHQRIHSGEKPYECSECGKAFSLSSNLIRHQRIHSGEEPYQCNECGKTFKRSSALVQHQRIHSGDEAYICNECGKAFRHRSVLMRHQRVHTIK

SEQ ID NO: 16140 - protein, 642 aa, Homo Sapiens
MAEAAPAPTSEWDSECLTSLQPLPLPTPPAANEAHLQTAAISLWTVVAAVQAIERKVEIHSRRLLHLEGRTGTAEKKLASCEKTVTELGNQLEGKWAVLGTLLQEYGLLQRRLENLENLLRNRNFWILRLPPGIKGDIPKVPVAFDDVSIYFSTPEWEKLEEWQKELYKNIMKGNYESLISMDYAINQPDVLSQIQPEGEHNTEDQAGPEESEIPTDPSEEPGISTSDILSWIKQEEEPQVGAPPESKESDVYKSTYADEELVIKAEGLARSSLCPEVPVPFSSPPAAAKDAFSDVAFKSQQSTSMTPFGRPATDLPEASEGQVTFTQLGSYPLPPPVGEQVFSCHHCGKNLSQDMLLTHQCSHATEHPLPCAQCPKHFTPQADLSSTSQDHASETPPTCPHCARTFTHPSRLTYHLRVHNSTERPFPCPDCPKRFADQARLTSHRRAHASERPFRCAQCGRSFSLKISLLLHQRGHAQERPFSCPQCGIDFNGHSALIRHQMIHTGERPYPCTDCSKSFMRKEHLLNHRRLHTGERPFSCPHCGKSFIRKHHLMKHQRIHTGERPYPCSYCGRSFRYKQTLKDHLRSGHNGGCGGDSDPSGQPPNPPGPLITGLETSGLGVNTEGLETNQWYGEGSGGGVL

SEQ ID NO: 16141 - protein, 552 aa, Homo Sapiens
MARVPLTFSDVAIDFSQEEWEYLNSDQRDLYRDVMLENYTNLVSLDFNFTTESNKLSSEKRNYEVNAYHQETWKRNKTFNLMRFIFRTDPQYTIEFGRQQRPKVGCFSQMIFKKHKSLPLHKRNNTREKSYECKEYKKGFRKYLHLTEHLRDHTGVIPYECNECGKAFVVFQHFIRHRKIHTDLKPYECNGCEKAFRFYSQLIQHQIIHTGMKPYECKQCGKAFRRHSHLTEHQKIHVGLKPFECKECGETFRLYRHMCLHQKIHHGVKPYKCKECGKAFGHRSSLYQHKKIHSGEKPYKCEQCEKAFVRSYLLVEHQRSHTGEKPHECMECGKAFGKGSSLLKHKRIHSSEKLYDCKDCGKAFCRGSQLTQHQRIHTGEKPHECKECGKTFKLHSYLIQHQIIHTDLKPYECKQCGKAFSRVGDLKTHQSIHAGEKPYECKECGKTFRLNSQLIYHQTIHTGLKPYVCKECKKAFRSISGLSQHKRIHTGEKPYECKECDKAFNRSDRLTQHETIHTGVKPQKCKECGKAFSHCYQLSQHQRFHHGERLLM

SEQ ID NO: 16142 - protein, 2248 aa, Homo Sapiens
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSEENLLNAHYLGKTHLRRQNLAARGGFVQILTKQPFPKKSRTMATKNVHSKPRTSKSIAKNSDSKGLRNVGSTFKDFRGSISKQSGSSSELLVEMMPSRNTLSQEVEIVEEHVTSLGLAQNPENQSRKLDTLVTSEGLLEKLESTKNTLQAAHGNSVTSRPRPERNILVLGNSFRRRSSTFTLKGQAKKRFNLLGIKRGTSETQRMYMKHLRTQMKTHDAESVLKHLEACSSVQRVCVTTSETQEAEQGQGSARPPDSGLHSLTVKPASGSQTLCACTDCGQVATNRTDLEIHVKRCHAREMKFYCRTCDFSSMSRRDLDEHLHSNQHQQTASVLSCQCCSFISLDEINLRDHMKEKHNMHFLCTPCNLFFLSEKDVEEHKATEKHINSLVQPKTLQSSNSDLVLQTLPLSTLESENAKESMDDSGKASQEEPLKSRVSHGNEVRHSSKPQFQCKKCFYKTRSSTVLTRHIKLRHGQDYHFLCKACNLYSLSKEGMEKHIKRSKHLENAKKNNIGLSFEECIERVCIGANDKKEEFDVSGNGRIEGHIGVQLQEHSYLEKGMLASEELSQSGGSTKDDELASTTTPKRGRPKGNISRTCSHCGLLASSITNLTVHIRRKHSHQYSYLCKVCKYYTVTKGDMERHCATKKHKGRVEIEASGKHSSDIIVGPEGGSLEAGKKNAGSAVTMSDEHANKPAESPTSVLEKPDRGNSIEAEVENVFHSLDGEVNSHLLDKKEQISSEPEDFAQPGDVYSQRDVTGTGENKCLHCEFSAHSSASLELHVKRKHTKEFEFYCMACDYYAVTRREMTRHAATEKHKMKRQSYLNSANVEAGSADMSKNIIMPEEEHQQNSEEFQIISGQPSDTLKSRNAADCSILNENTNLDMSKVLCAADSVEVETEEESNFNEDHSFCETFQQAPVKDKVRKPEEMMSLTMSSNYGSPSRFQNENSGSSALNCETAKKNHEISNDAGELRVHCEGEGGNAGDGGGVVPHRHLCPVTLDGERSAESPVLVVTRITREQGNLESGGQNRVARGHGLEDLKGVQEDPVLGNKEILMNSQHETEFILEEDGPASDSTVESSDVYETIISIDDKGQAMYSFGRFDSSIIRIKNPEDGELIDQSEEGLIATGVRISELPLKDCAQGVKKKKSEGSSIGESTRIRCDDCGFLADGLSGLNVHIAMKHPTKEKHFHCLLCGKSFYTESNLHQHLASAGHMRNEQASVEELPEGGATFKCVKCTEPFDSEQNLFLHIKGQHEELLREVNKYIVEDTEQINREREENQGNVCKYCGKMCRSSNSMAFLAHIRTHTGSKPFKCKICHFATAQLGDARNHVKRHLGMREYKCHVCGVAFVMKKHLNTHLLGKHGVGTPKERKFTCHLCDRSFTEKWALNNHMKLHTGEKPFKCTWPTCHYSFLTASAMKDHYRTHTGEKSFLCDLCGFAGGTRHALTKHRRQHTGEKPFKCDECNFASTTQSHLTRHKRVHTGEKPYRCPWCDYRSNCAENIRKHILHTGKHEGVKMYNCPKCDYGTNVPVEFRNHLKEQHPDIENPDLAYLHAGIVSKSYECRLKGQGATFVETDSPFTAAALAEEPLVKEKPLRSSRRPAPPPEQVQQVIIFQGYDGEFALDPSVEETAAATLQTLAMAGQVARVVHITEDGQVIATSQSGAHVGSVVPGPILPEQLADGATQVVVVGGSMEGHGMDESLSPGGAVIQQVTKQEILNLSEAGVAPPEASSALDALLCAVTELGEVEGRAGLEEQGRPGAKDVLIQLPGQEVSHVAADPEAPEIQMFPQAQESPAAVEVLTQVVHPSAAMASQERAQVAFKKMVQGVLQFAVCDTAAAGQLVKDGVTQVVVSEEGAVHMVAGEGAQIIMQEAQGEHMDLVESDGEISQIIVTEELVQAMVQESSGGFSEGTTHYILTELPPGVQDEPGLYSHTVLETADSQELLQAGATLGTEAGAPSRAEQLASVVIYTQEGSSAAAAIQSQRESSELQEA

SEQ ID NO: 16143 - protein, 720 aa, Homo Sapiens
MEEAEELLLEGKKALQLAREPRLGLDLGWNPSGEGCTQGLKDVPPEPTRDILALKSLPRGLALGPSLAKEQRLGVWCVGDPLQPGLLWGPLEEESASKEKGEGVKPRQEENLSLGPWGDVCACEQSSGWTSLVQRGRLESEGNVAPVRISERLHLQVYQLVLPGSELLLWPQPSSEGPSLTQPGLDKEAAVAVVTEVESAVQQEVASPGEDAAEPCIDPGSQSPSGIQAENMVSPGLKFPTQDRISKDSQPLGPLLQDGDVDEECPAQAQMPPELQSNSATQQDPDGSGASFSSSARGTQPHGYLAKKLHSPSDQCPPRAKTPEPGAQQSGFPTLSRSPPGPAGSSPKQGRRYRCGECGKAFLQLCHLKKHAFVHTGHKPFLCTECGKSYSSEESFKAHMLGHRGVRPFPCPQCDKAYGTQRDLKEHQVVHSGARPFACDQCGKAFARRPSLRLHRKTHQVPAAPAPCPCPVCGRPLANQGSLRNHMRLHTGEKPFLCPHCGRAFRQRGNLRGHLRLHTGERPYRCPHCADAFPQLPELRRHLISHTGEAHLCPVCGKALRDPHTLRAHERLHSGERPFPCPQCGRAYTLATKLRRHLKSHLEDKPYRCPTCGMGYTLPQSLRRHQLSHRPEAPCSPPSVPSAASEPTVVLLQAEPQLLDTHREEEVSPARDVVEVTISESQEKCFVVPEEPDAAPSLVLIHKDMGLGAWAEVVEVEMGT

SEQ ID NO: 16144 - protein, 821 aa, Homo Sapiens
MAANGDSPPWSPALAAEGRGSSCEVRRERTPEARIHSVKRYPDLSPGPKGRSSADHAALNSIVSLQASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHKQAPTHHQKIHPEEKLYVCTECVMGFTQKSHLFEHQRIHAGEKSRECDKSNKVFPQKPQVDVHPSVYTGEKPYLCTQCGKVFTLKSNLITHQKIHTGQKPYKCSECGKAFFQRSDLFRHLRIHTGEKPYECSECGKGFSQNSDLSIHQKTHTGEKHYECNECGKAFTRKSALRMHQRIHTGEKPYVCADCGKAFIQKSHFNTHQRIHTGEKPYECSDCGKSFTKKSQLHVHQRIHTGEKPYICTECGKVFTHRTNLTTHQKTHTGEKPYMCAECGKAFTDQSNLIKHQKTHTGEKPYKCNGCGKAFIWKSRLKIHQKSHIGERHYECKDCGKAFIQKSTLSVHQRIHTGEKPYVCPECGKAFIQKSHFIAHHRIHTGEKPYECSDCGKCFTKKSQLRVHQKIHTGEKPNICAECGKAFTDRSNLITHQKIHTREKPYECGDCGKTFTWKSRLNIHQKSHTGERHYECSKCGKAFIQKATLSMHQIIHTGKKPYACTECQKAFTDRSNLIKHQKMHSGEKRYKASD

SEQ ID NO: 16145 - protein, 478 aa, Homo Sapiens
MLSDELESKPELLVQFVQNTSIPLGQGLVESEAKDITCLSLLPVTEASECSRLMLPDDTTNHSNSSKEVPSSAVLRSLRVNVGPDGEETRAQTVQKSPEFLSTSESSSLLQDLQPSDSTSFILLNLTRAGLGSSAEHLVFVQDEAEDSGNDFLSSESTDSSIPWFLRVQELAHDSLIAATRAQLAKNAKTSSNGENVHLGSGDGQSKDSGPLPQVEKKLKCTVEGCDRTFVWPAHFKYHLKTHRNDRSFICPAEGCGKSFYVLQRLKVHMRTHNGEKPFMCHESGCGKQFTTAGNLKNHRRIHTGEKPFLCEAQGCGRSFAEYSSLRKHLVVHSGEKPHQCQVCGKTFSQSGSRNVHMRKHHLQLGAAGSQEQEQTAEPLMGSSLLEEASVPSKNLVSMNSQPSLGGESLNLPNTNSILGVDDEVLAEGSPRSLSSVPDVTHHLVTMQSGRQSYEVSVLTAVNPQELLNQGDLTERRT

SEQ ID NO: 16146 - protein, 312 aa, Homo Sapiens
MEEKPSGPIPDMLATAEPSSSETDKEVLSPAVPAAAPSSSMSEEPGPEQAATPPVWERGGAGGMQQGSSPAPDSCQPGPGPSPGLTSIVSGTSEDLRPPRRRPPPGKQIPCSSPGCCLSFPSVRDLAQHLRTHCPPTQSLEGKLFRCSALSCTETFPSMQELVAHSKLHYKPNRYFKCENCLLRFRTHRSLFKHLHVCAEHAQSPAPPPPPALDREPPAPERPPEVDPASAPGLPFPLLEPFTTPAPAPTGPFLPYLNPAPFGLSPPRLRPFLAAAPGPPASSAAVWKKSQGAGSSPRRPQGGSDAPSGACR

SEQ ID NO: 16147 - protein, 603 aa, Homo Sapiens
MPELYTEDFIQGCDVGELQEPGLPGVLSYVGAQERALDHRKPSTSSKKTKRVEIDQRCENRLECNGAISAHCNLRLPDSNDSPASASRVAGITDLSRNCVIKELAPQQEGNPGEVFHTVTLEQHEKHDIEEFCFREIKKKIHDFDCQWRDDERNCNKVTTAPKENLTCRRDQRDRRGIGNKSIKHQLGLSFLPHPHELQQFQAEGKIYECNHVEKSVNHGSSVSPPQIISSTIKTHVSNKYGTDFICSSLLTQEQKSCIREKPYRYIECDKALNHGSHMTVRQVSHSGEKGYKCDLCGKVFSQKSNLARHWRVHTGEKPYKCNECDRSFSRNSCLALHRRVHTGEKPYKCYECDKVFSRNSCLALHQKTHIGEKPYTCKECGKAFSVRSTLTNHQVIHSGKKPYKCNECGKVFSQTSSLATHQRIHTGEKPYKCNECGKVFSQTSSLARHWRIHTGEKPYKCNECGKVFSYNSHLASHRRVHTGEKPYKCNECGKAFSVHSNLTTHQVIHTGEKPYKCNQCGKGFSVHSSLTTHQVIHTGEKPYKCNECGKSFSVRPNLTRHQIIHTGKKPYKCSDCGKSFSVRPNLFRHQIIHTKEKPYKRN

SEQ ID NO: 16148 - protein, 594 aa, Homo Sapiens
MAAAVLRDSTSVPVTAEAKLMGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCECSLVQLQRVHPGERPYECSECGKSFSQTSHLNDHRRIHTGERPYVCGQCGKSFSQRATLIKHHRVHTGERPYECGECGKSFSQSSNLIEHCRIHTGERPYECDECGKAFGSKSTLVRHQRTHTGEKPYECGECGKLFRQSFSLVVHQRIHTTARPYECGQCGKSFSLKCGLIQHQLIHSGARPFECDECGKSFSQRTTLNKHHKVHTAERPYVCGECGKAFMFKSKLVRHQRTHTGERPFECSECGKFFRQSYTLVEHQKIHTGLRPYDCGQCGKSFIQKSSLIQHQVVHTGERPYECGKCGKSFTQHSGLILHRKSHTVERPRDSSKCGKPYSPRSNIV

SEQ ID NO: 16149 - protein, 575 aa, Homo Sapiens
MAAAAPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEAAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGKTAYPCEECGKSFSQKGSLISHQRVHTGERPYECREYGKSFGQKGNLIQHQQGHTGERAYHCGECGKSFRQKFCFINHQRVHTGERPYKCGECGKSFGQKGNLVQHQRGHTGERPYECKECGKSFRYRSHLTEHQRLHTGERPYNCRECGKLFNRKYHLLVHERVHTGERPYACEVCGKLFGNKNCVTIHQRIHTGERPYECNECGKSFLSSSALHVHKRVHSGQKPYKCSECGKSFAECSSLIKHRRIHTGERPYECTKCGKTFQRSSTLLHHQSSHRRKAL

SEQ ID NO: 16150 - protein, 676 aa, Homo Sapiens
MQGTVAFEDVAVNFSQEEWSLLSEVQRCLYHDVMLENWVLISSLGCWCGSEDEEAPSKKSISIQRVSQVSTPGAGVSPKKAHSCEMCGAILGDILHLADHQGTHHKQKLHRCEAWGNKLYDSSNRPHQNQYLGEKPYRSSVEEALFVKRCKFHVSEESSIFIQSGKDFLPSSGLLLQEATHTGEKSNSKPECESPFQWGDTHYSCGECMKHSSTKHVFVQQQRLPSREECYCWECGKSFSKYDSVSNHQRVHTGKRPYECGECGKSFSHKGSLVQHQRVHTGKRPYECGECGKSFSHKGSLVQHQRVHTGERPYECGECGKSFSQNGTLIKHQRVHTGERPYECEECGKCFTQKGNLIQHQRGHTSERPYECEECGKCFSQKGTLTEHHRVHTRERPYECGECGKSFSRKGHLRNHQRGHTGERPYECGECGKSFSRKGNLIQHQRSHTGERPYECRECRKLFRGKSHLIEHQRVHTGERPYECNECGKSFQDSSGFRVHQRVHTGEKPFECSECGKSFPQSCSLLRHRRVHTGERPYECGECGKSFHQSSSLLRHQKTHTAERPYECRECGKFFSSLLEHRRVHTGERPYECRECGKTFTRRSAHFKHQRLHTRGKPYECSECGKSFAETFSLTEHRRVHTGERPYECSECGKSFHRSSSLLRHQRVHTERSPYK

SEQ ID NO: 16151 - protein, 510 aa, Homo Sapiens; identical to SEQ ID NO: 14420

SEQ ID NO: 16152 - protein, 688 aa, Homo Sapiens
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTGEKPYECKQCGKAFSRDSQLSLHQRLHTGEKPYACKECGKAFTQSSQLILHHRIHTGEKPYKCEECGKAFIRSSQLTRHQKVHTGEKPYECKECGKAFTQNSQLTLHQRLHTGEKLYECKECRKVFTQLSQLILHKRIHTGEKPYECKECGKAFICGSQLSQHQKIHNGEKPYECKECGRAFIRGSLLMQHQRIHTGEKPYKCEECGKAFIRGSQLTQHQRIHTNEKPYECKECGKMFSHGSQLTQHQRIHTGEKPYQCKECGKAFNRGSLLTRHQRIHTGEKPYECKECGKTFSRGSELTQHERIHTGEKPYECKECGKSFIRGSQLTQHQRIHTGEKPYECKECRMAFTQSSHLSQHQRLHTGEKPYVCNECGKAFARGLLLIQHQRIHTGEKPYQCKECGKAFIRGSQLTQHQRIHTGEKPYECKECGKAFSHGSQLTLHQRIHTGEKPYECRECRKAFTQSSHLSRHQRIHTGEKPYQCKECGKAFTRGSQLTQHQRIHISEKSFEYKECGIDFSHGSQVYM

SEQ ID NO: 16153 - protein, 1284 aa, Homo Sapiens
MHKKRVEEGEASDFSLAWDSSVTAAGGLEGEPECDQKTSRALEDRNSVTSQEERNEDDEDMEDESIYTCDHCQQDFESLADLTDHRAHRCPGDGDDDPQLSWVASSPSSKDVASPTQMIGDGCDLGLGEEEGGTGLPYPCQFCDKSFIRLSYLKRHEQIHSDKLPFKCTYCSRLFKHKRSRDRHIKLHTGDKKYHCHECEAAFSRSDHLKIHLKTHSSSKPFKCTVCKRGFSSTSSLQSHMQAHKKNKEHLAKSEKEAKKDDFMCDYCEDTFSQTEELEKHVLTRHPQLSEKADLQCIHCPEVFVDENTLLAHIHQAHANQKHKCPMCPEQFSSVEGVYCHLDSHRQPDSSNHSVSPDPVLGSVASMSSATPDSSASVERGSTPDSTLKPLRGQKKMRDDGQGWTKVVYSCPYCSKRDFNSLAVLEIHLKTIHADKPQQSHTCQICLDSMPTLYNLNEHVRKLHKNHAYPVMQFGNISAFHCNYCPEMFADINSLQEHIRVSHCGPNANPSDGNNAFFCNQCSMGFLTESSLTEHIQQAHCSVGSAKLESPVVQPTQSFMEVYSCPYCTNSPIFGSILKLTKHIKENHKNIPLAHSKKSKAEQSPVSSDVEVSSPKRQRLSASANSISNGEYPCNQCDLKFSNFESFQTHLKLHLELLLRKQACPQCKEDFDSQESLLQHLTVHYMTTSTHYVCESCDKQFSSVDDLQKHLLDMHTFVLYHCTLCQEVFDSKVSIQVHLAVKHSNEKKMYRCTACNWDFRKEADLQVHVKHSHLGNPAKAHKCIFCGETFSTEVELQCHITTHSKKYNCKFCSKAFHAIILLEKHLREKHCVFDAATENGTANGVPPMATKKAEPADLQGMLLKNPEAPNSHEASEDDVDASEPMYGCDICGAAYTMEVLLQNHRLRDHNIRPGEDDGSRKKAEFIKGSHKCNVCSRTFFSENGLREHLQTHRGPAKHYMCPICGERFPSLLTLTEHKVTHSKSLDTGTCRICKMPLQSEEEFIEHCQMHPDLRNSLTGFRCVVCMQTVTSTLELKIHGTFHMQKLAGSSAASSPNGQGLQKLYKCALCLKEFRSKQDLVKLDVNGLPYGLCAGCMARSANGQVGGLAPPEPADRPCAGLRCPECSVKFESAEDLESHMQVDHRDLTPETSGPRKGTQTSPVPRKKTYQCIKCQMTFENEREIQIHVANHMIEEGINHECKLCNQMFDSPAKLLCHLIEHSFEGMGGTFKCPVCFTVFVQANKLQQHIFAVHGQEDKIYDCSQCPQKFFFQTELQNHTMSQHAQ

SEQ ID NO: 16154 - protein, 752 aa, Homo Sapiens
MAEPASVTVTFDDVALYFSEQEWEILEKWQKQMYKQEMKTNYETLDSLGYAFSKPDLITWMEQGRMLLISEQGCLDKTRRTTSPPTDEQLNMKNTGKLLCFDDEGTPRTKEEDCRLNGPQKQDLCAALRGKERKILLAQTATFQSPSLRETEILNKKVSITAYDPDKKDLRHKPRETPGRLEIPTGPRCYSCYVCRKVFQVRRDLLKHKRSHSKSQLCRYPKYKNSSRGKSELRRTQRLLCQKKRFQCSECEKSYFLKGSLVTHQVVHTGQRPYPCPECDKTFRYRANLKKHLCLHRGERPFCCGECGRAFVQQCELTEHLRLHSGEKPFQCPQCDRCFRLKRGMKVHLTQHSGKRPFHCPECGRSFSRKAALKTHQRTHSEEKPFSCGECGRKFIYKIKLDEHIRVHTGEKPFSCPECNKSFRLKRSLKAHGLQHIGKRPFQCPECSRGFFWRNAMRAHQRLHSEQKPFPCAECGKRFTRPSKLACHTRVHDRQKEFPCGECKKTFSQQSRLTQHLKVHTTEKPFSCAECGRSFRRRAHLTEHTRLHSGEEPFQCPECDKSFSWKASMKFHQRMHRDEKPFACGECDKTYTHQSQLTEHLRLHSGEKPYQCPECEKTFRLKGNLKSHLLQHSGQKPFSCVMCGKSFTQQYRLTEHIRVHSGEKPFQCPECDKSYCIRGSLKVHLYKHSGERPFQCPECGKGFLQKRSLKAHLCLHSGERPFSCDECGRSFTYVGALKTHIAVHAKEKPSSL

SEQ ID NO: 16155 - protein, 554 aa, Homo Sapiens
MAAADLSHGHYLSGDPVCLHEEKTPAGRIVADCLTDCYQDSVTFDDVAVDFTQEEWTLLDSTQRSLYSDVMLENYKNLATVGGQIIKPSLISWLEQEESRTVQGGVLQGWEMRLETQWSILQQDFLRGQTSIGIQLEGKHNGRELCDCEQCGEVFSEHSCLKTHVRTQSTGNTHDCNQYGKDFLTLCEKTSTGEKLSEFNQSEKIFSLTPNIVYQRTSTQEKSFECSHCGKSFINESYLQAHMRTHNGEKLYEWRNYGPGFIDSTSLSVLIETLNAKKPYKCKECGKGYRYPAYLSIHMRTHTGEKPYECKECGKAFNYSNSFQIHGRTHTGEKPYVCKECGKAFTQYSGLSMHVRSHSGDKPYECKECGKSFLTSSRLIQHIRTHTGEKPFVCVECGKAFAVSSNLSGHLRTHTEEKACECKICGKVFGYPSCLNNHMRTHSAQKPYTCKECGKAFNYSTHLKIHMRIHTGEKPYECKQCGKAFSHSSSFQIHERTHTGEKPYECKECGKAFTCSSSFRIHEKTHTEEKPYKCQQCGKAYSHPRSLRRHEQIH

SEQ ID NO: 16156 - protein, 188 aa, Homo Sapiens
MTETREPAETGGYASLEEDDEDLSPGPEHSSDSEYTLSEPDSEEEEDEEEEEEETTDDPEYDPGYKVKQRLGGGRGGPSRRAPRAAQPPAQPCQLCGRSPLGEAPPGTPPCRLCCPATAPQEAPAPEGRALGEEEEEPPRAGEGRPAGREEEEEEEEEGTYHCTECEDSFDNLGELHGHFMLHARGEV

SEQ ID NO: 16157 - protein, 674 aa, Homo Sapiens
MGPLTFTDVAIEFSLEEWQCLDTAQQNLYRNVMLENYRNLVFLGIAVSKPDLITCLEKEKEPCKMKRHEMVDEPPVVCSHFAEDFWPEQDIKDSFQKVTLRRYDKRGHENLQLRKGYKTVGDCKLYKGGYNGLNQCLTLTQSKMYHCDIYVKVFYAFSNADRYKTRHTGKKPFQCKKCGKSFCMLSQLTQHKKIHIRENTYRCKEFGNAFNQSSALTNHKRIYVGEKHYRCEECGKAFNHYSTLTNHKRIHTGEKPYKCKECGKAFSRYSTLTTHKRIHSGEKPYKCDECGKTFSISSTFTKHKIIHTEEKPYKCKECGKAFNRSSTLTSHKRIHTGEKPYKCEECGKAFNWSSTLTKHKVIHTGEKPYKCEECGKAFNQSSRLTRHKKIHTGEEPYKFEKCGRVFTCSSTLTQDKKIHTGEKPYNCEECGKVFTYSSTLTRHKRIHTEEKPYKCNECGKAFNRSSHLTSHRRIHTGEKPYKCEECGKAFKQSSNLNSHKKIHSGEKPYKCEECGKAFILSSRLTQHKKIHTGEKPYKCEECGKAFNRSSRLTQHKKIHTGEKPYKCKQCDKAFTHSSNLSSHKKIHSGEKPYKCEECGKAFNRSSRLTQHKKIHTREKPYKCEECAKAFTRSSRLTQHKKIHRMGVVAHACNPSTLGGRGGRITRSGDRDRPG

SEQ ID NO: 16158 - protein, 809 aa, Homo Sapiens
MGPLTFMDVAIEFCLEEWQCLDIAQQNLYRNVMLENYRNLVFLGIAVSKPDLITCLEQEKEPWEPMRRHEMVAKPPVMCSHFTQDFWPEQHIKDPFQKATLRRYKNCEHKNVHLKKDHKSVDECKVHRGGYNGFNQCLPATQSKIFLFDKCVKAFHKFSNSNRHKISHTEKKLFKCKECGKSFCMLPHLAQHKIIHTRVNFCKCEKCGKAFNCPSIITKHKRINTGEKPYTCEECGKVFNWSSRLTTHKKNYTRYKLYKCEECGKAFNKSSILTTHKIIRTGEKFYKCKECAKAFNQSSNLTEHKKIHPGEKPYKCEECGKAFNWPSTLTKHKRIHTGEKPYTCEECGKAFNQFSNLTTHKRIHTAEKFYKCTECGEAFSRSSNLTKHKKIHTEKKPYKCEECGKAFKWSSKLTEHKLTHTGEKPYKCEECGKAFNWPSTLTKHNRIHTGEKPYKCEVCGKAFNQFSNLTTHKRIHTAEKPYKCEECGKAFSRSSNLTKHKKIHIEKKPYKCEECGKAFKWSSKLTEHKITHTGEKPYKCEECGKAFNHFSILTKHKRIHTGEKPYKCEECGKAFTQSSNLTTHKKIHTGEKFYKCEECGKAFTQSSNLTTHKKIHTGGKPYKCEECGKAFNQFSTLTKHKIIHTEEKPYKCEECGKAFKWSSTLTKHKIIHTGEKPYKCEECGKAFKLSSTLSTHKIIHTGEKPYKCEKCGKAFNRSSNLIEHKKIHTGEQPYKCEECGKAFNYSSHLNTHKRIHTKEQPYKCKECGKAFNQYSNLTTHNKIHTGEKLYKPEDVTVILTTPQTFSNIK

SEQ ID NO: 16159 - protein, 570 aa, Homo Sapiens
MENLKSGVYPLKEASGCPGADRNLLVYSFYEKGPLTFRDVAIEFSLEEWQCLDTAQQDLYRKVMLENYRNLVFLAGIAVSKPDLITCLEQGKEPWNMKRHAMVDQPPVTYSHFAQDLWPEQGIKDSFQEVILRRYGKCGHEDLQLRTGCKSVDECNLHKECYDELNQCLTTTQSEIFQYDKYVNVFYKFSNPNIQKIRHTGKKPFKCKKCDKSFCMLLHLTQHKRIHIRENSYQCEECGKVFNWFSTLTRHRRIHTGEKPYKCEQCGKAFKQSSTLTTHKIIHTGEKPYRCEECGKTFNRSSHLTTHKRIHTGEKPYRCEECGRAFNRSSHLTTHKIIHTGEKPYKCEECGKAFNQSSTLTTHKIIHAGEKPYKCEECGKAFYRFSYLTKHKIIHTGEKFYKCEECGKGFNWSSTLTKHKRIHTGEKPYKCEQCGKAFNESSNLTAHKIIHTGEKPYKCEECGKAFNRSPKLTAHKVIHSGEKPYKCEECGKAFNQFSNLTKHKITHIGDTSYKYLECDKAFSQSSTLTKHKVIHTGEKPYNCEEYGKAFNQSSNLIEQSNSYWRETLQM

SEQ ID NO: 16160 - protein, 576 aa, Homo Sapiens
MDDLKYGVYPLKEASGCPGAERNLLVYSYFEKETLTFRDVAIEFSLEEWECLNPAQQNLYMNVMLENYKNLVFLGVAVSKQDPVTCLEQEKEPWNMKRHEMVDEPPAMCSYFTKDLWPEQDIKDSFQQVILRRYGKCEHENLQLRKGSASVDEYKVHKEGYNELNQCLTTTQSKIFPCDKYVKVFHKFLNANRHKTRHTGKKPFKCKKCGKSFCMLLHLSQHKRIHIRENSYQCEECGKAFKWFSTLTRHKRIHTGEKPFKCEECGKAFKQSSTLTTHKIIHTGEKPYRCEECGKAFNRSSHLTTHKIIHTGEKPYKCEECGKAFNQSSTLSTHKFIHAGEKPYKCEECDKAFNRFSYLTKHKIIHTGEKSYKCEECGKGFNWSSTLTKHKRIHTGEKPYKCEVCGKAFNESSNLTTHKMIHTGEKPYKCEECGKAFNRSPQLTAHKIIHTGEKPYKCEECGKAFSQSSILTTHKRIHTGEKPYKCEECGKAFNRSSNLTKHKIIHTGEKSYKCEECGKAFNQSSTLTKHRKIHTRQKPYNCEECDNTFNQSSNLIKQNNSYWRETLQMSRMWESL

SEQ ID NO: 16161 - protein, 652 aa, Homo Sapiens
MINAQELLTLEDVTVEFTWEEWQLLGPFQKDLYRDVMLEIYSNLLSMGYQVSKPDALSKLERGEEPWTMEDERHSRICPENNEVDDHLQDHLENQRMLKSVEQYHEHNAFGNTASQTKSLCLFRENHDTFELYIKTLKSNLSLVNQNKSCEINNSTKFSGDGKSFLHGNYEELYSAAKFSVSTKANSTKSQVSKHQRTHEIEKNHVCSECGKAFVKKSQLTDHERVHTGEKPYGCTLCAKVFSRKSRLNEHQRIHKREKSFICSECGKVFTMKSRLIEHQRTHTGEKPYICNECGKGFPGKRNLIVHQRNHTGEKSYICSECGKGFTGKSMLIIHQRTHTGEKPYICSECGKGFTTKHYVIIHQRNHTGEKPYICNECGKGFTMKSRMIEHQRTHTGEKPYICSECGKGFPRKSNLIVHQRNHTVEKSYLCSECGKGFTVKSMLIIHQRTHTGEKPYTCSECGKGFPLKSRLIVHQRTHTGEKPYRCSECGKGFIVNSGLMLHQRTHTGEKPYICNECGKGFAFKSNLVVHQRTHTGEKPFMCSECGKGFTMKRYLIVHQQIHTEEKSCICSECGRGFAKETELALHKQVHTGEKPYGCNECGKGFTMKSRLIVHQRTHTGEKPFVCSECRKAFSSKRNLIVHQRTHNGNKP

SEQ ID NO: 16162 - protein, 673 aa, Homo Sapiens; identical to SEQ ID NO: 14432

SEQ ID NO: 16163 - protein, 470 aa, Homo Sapiens
MAATLLMAGSQAPVTFEDMAMYLTREEWRPLDAAQRDLYRDVMQENYGNVVSLDFEIRSENEVNPKQEISEDVQFGTTSERPAENAEENPESEEGFESGDRSERQWGDLTAEEWVSYPLQPVTDLLVHKEVHTGIRYHICSHCGKAFSQISDLNRHQKTHTGDRPYKCYECGKGFSRSSHLIQHQRTHTGERPYDCNECGKSFGRSSHLIQHQTIHTGEKPHKCNECGKSFCRLSHLIQHQRTHSGEKPYECEECGKSFSRSSHLAQHQRTHTGEKPYECNECGRGFSERSDLIKHYRVHTGERPYKCDECGKNFSQNSDLVRHRRAHTGEKPYHCNECGENFSRISHLVQHQRTHTGEKPYECNACGKSFSRSSHLITHQKIHTGEKPYECNECWRSFGERSDLIKHQRTHTGEKPYECVQCGKGFTQSSNLITHQRVHTGEKPYECTECEKSFSRSSALIKHKRVHTD

SEQ ID NO: 16164 - protein, 828 aa, Homo Sapiens
MQNSVSVPPKDEGESNIPSGTIQSRKGLQNKSQFRTIAPKIVPKVLTSRMLPCHSPSRSDQVNLGPSINSKLLGMSTQNYALMQVAGQEGTFSLVALPHVASAQPIQKPRMSLPENLKLPIPRYQPPRNSKASRKKPILIFPKSGCSKAPAQTQMCPQMSPSPPHHPELLYKPSPFEEVPSLEQAPASISTAALTNGSDHGDLRPPVTNTHGSLNPPATPASSTPEEPAKQDLTALSGKAHFVSKITSSKPSAVASEKFKEQVDLAKTMTNLSPTILGNAVQLISSVPKGKLPIPPYSRMKTMEVYKIKSDANIAGFSLPGPKADCDKIPSTTEGFNAATKVASRLPVPQVSQQSACESAFCPPTKLDLNHKTKLNSGAAKRKGRKRKVPDEILAFQGKRRKYIINKCRDGKERVKNDPQEFRDQKLGTLKKYRSIMPKPIMVIPTLASLASPTTLQSQMLGGLGQDVLLNNSLTPKYLGCKQDNSSSPKPSSVFRNGFSGIKKPWHRCHVCNHHFQFKQHLRDHMNTHTNRRPYSCRICRKSYVRPGSLSTHMKLHHGENRLKKLMCCEFCAKVFGHIRVYFGHLKEVHRVVISTEPAPSELQPGDIPKNRDMSVRGMEGSLERENKSNLEEDFLLNQADEVKLQIKCGRCQITAQSFAEIKFHLLDVHGEEIEGRLQEGTFPGSKGTQEELVQHASPDWKRHPERGKPEKVHSSSEESHACPRLKRQLHLHQNGVEMLMENEGPQSGTNKPRETCQGPECPGLHTFLLWSHSGFNCLLCAEMLGRKEDLLHHWKHQHNCEDPSKLWAILNTVSNQGVIELSSEAEK

SEQ ID NO: 16165 - protein, 499 aa, Homo Sapiens
MLSLSPILLYTCEMFQDPVAFKDVAVNFTQEEWALLDISQKNLYREVMLETFWNLTSIGKKWKDQNIEYEYQNPRRNFRSVTEEKVNEIKEDSHCGETFTPVPDDRLNFQKKKASPEVKSCDSFVCEVGLGNSSSNMNIRGDTGHKACECQEYGPKPWKSQQPKKAFRYHPSLRTQERDHTGKKPYACKECGKNIIYHSSIQRHMVVHSGDGPYKCKFCGKAFHCLSLYLIHERTHTGEKPYECKQCGKSFSYSATHRIHERTHIGEKPYECQECGKAFHSPRSCHRHERSHMGEKAYQCKECGKAFMCPRYVRRHERTHSRKKLYECKQCGKALSSLTSFQTHIRMHSGERPYECKTCGKGFYSAKSFQRHEKTHSGEKPYKCKQCGKAFTRSGSFRYHERTHTGEKPYECKQCGKAFRSAPNLQLHGRTHTGEKPYQCKECGKAFRSASQLRIHRRIHTGEKPYECKKCGKAFRYVQNFRFHERTQTHKNALWRKTL

SEQ ID NO: 16166 - protein, 663 aa, Homo Sapiens
MALCYGTFWGYPKMLEAANLMEGLVDIGPWVTLPRGQPEVLEWGLPKDQDSVAFEDVAVNFTHEEWALLGPSQKNLYRDVMRETIRNLNCIGMKWENQNIDDQHQNLRRNPRCDVVERFGKSKDGSQCGETLSQIRNSIVNKNTPARVDACGSSVNGEVIMGHSSLNCYIRVDTGHKHRECHEYAEKSYTHKQCGKGLSYRHSFQTCERPHTGKKPYDCKECGKTFSSPGNLRRHMVVKGGDGPYKCELCGKAFFWPSLLRMHERTHTGEKPYECKQCSKAFPVYSSYLRHEKIHTGEKPYECKQCSKAFPDYSSYLRHERTHTGEKPYKCKQCGKAFSVSGSLRVHERIHTGEKPYTCKQCGKAFCHLGSFQRHMIMHSGDGPHKCKICGKGFDFPGSARIHEGTHTLEKPYECKQCGKLLSHRSSFRRHMMAHTGDGPHKCTVCGKAFDSPSVFQRHERTHTGEKPYECKQCGKAFRTSSSLRKHETTHTGEQPYKCKCGKAFSDLFSFQSHETTHSEEEPYECKECGKAFSSFKYFCRHERTHSEEKSYECQICGKAFSRFSYLKTHERTHTAEKPYECKQCRKAFFWPSFLLRHERTHTGERPYECKHCGKAFSRSSFCREHERTHTGEKPYECKECGKAFSSLSSFNRHKRTHWKDIL

SEQ ID NO: 16167 - protein, 595 aa, Homo Sapiens
MDPVAFKDVAVNFTQEEWALLDISQRKLYREVMLETFRNLTSLGKRWKDQNIEYEHQNPRRNFRSLIEEKVNEIKDDSHCGETFTPVPDDRLNFQEKKASPEVKSCESFVCGEVGLGNSSFNMNIRGDIGHKAYEYQEYGPKPCKCQQPKKAFRYRPSFRTQERDHTGEKPNACKVCGKTFISHSSVRRHMVMHSGDGPYKCKFCGKAFHCLRLYLIHERIHTGEKPCECKQCGKSFSYSATHRIHKRTHTGEKPYEYQECGKAFHSPRSYRRHERIHMGEKAYQCKECGKAFTCPRYVRIHERTHSRKNLYECKQCGKALSSLTSFQTHVRLHSGERPYECKICGKDFCSVNSFQRHEKIHSGEKPYKCKQCGKAFPHSSSLRYHERTHTGEKPYECKQCGKAFRSASHLRVHGRTHTGEKPYECKECGKAFRYVNNLQSHERTQTHIRIHSGERRYKCKICGKGFYCPKSFQRHEKTHTGEKLYECKQRSVVPSVVPVPFDIMKGLTLERSPINASNVGKPSELCQSFECMVGLTLKRNPMSVSNDGKPSDLPHTFEYVVGHTMERSPMHVRNVGNPSDLPRTFEFMKGHKHT

SEQ ID NO: 16168 - protein, 693 aa, Homo Sapiens
MDSVAFEDVAINFTCEEWALLGPSQKSLYRDVMQETIRNLDCIGMIWQNHDIEEDQYKDLRRNLRCHMVERACEIKDNSQCGGPFTQTQDSIVNEKIPGVDPWESSECTDVLMGRSSLNCYVRVDSEHKPCEYQEYGEKPYTHTQCGTAFSYQPCFQIHERPQHGKKLYDCKECASFSSLENLQRHMAAHHGDGPRICKLCGNAFIWPSLFHMLRRTHTEEKPYEYEQCSTAFPAYSSTLRHERTHSGEKPYQCKQCGKAFSCSCYTQLYERTHTGEQSYECKQCGKAFYHLGSFQRHMIVHTGDGPHKCKICGKGFLSPSSVRRHKRTHTGEKPYECKYCGKAFSDCTGFRRHMITHTGDGPHKCKVCGKAFDSPSLCRRHETTHTGEKPYKCECGKAFSDFYYFRNHETTHTGEKPYKCKQCGKAFICCTYLQIHERIHTGERPYKCKQCGKAFRSSNYIRVHEKTHTGEKPYECKQCGKALSHLKSFQRHMIMHTGDGPHKCKICGKSFDSPSSFRRHERIHTGERPYKCKLCGKGFRSSSYIQLHERTHTGEKPYGCQQCGKALSDLSSFRRHMITHTGNGPHKCKICGKGFDYPSSVQRHERTHTGEKPYECKECGKAFSHSSYLRIHERVHTGEKPYKCKECGKPFHCPSAFHKHERTHSMEKPYKCKECGEAFHCISSFHKHEMTH

SEQ ID NO: 16169 - protein, 627 aa, Homo Sapiens
MIVFGGEDRSDLFLPDSQTNEERKQYDSVAFEDVAVNFTQEEWALLGPSQKSLYRDVMWETIRNLDCIGMKWEDTNIEDQHRNPRRSLRCHIIERFSESRQPDSTVNEKPPGVDPCKSSVCGEIMGCSFLNCYITFDAGHKPDECQEYGEKPHTHKQCGTAFNYHHSFQTQERPHTGKKRYDCKECGKTFSSSGNLRRHIIVQRGGGPYICKLCGKAFFWPSLFRMHERTHTGEKPYECKQCCKAFPIYSSYLRHERTHTGEKPYECKHCSKAFPDYSSYVRHERTHTGEKPYKCKRCGRAFSVSSSLRIHERTHTGEKPYECKQCGKAFHHLGSFQRHMIRHTGDGPHKCKICGKGFDCPSSLQSHERTHTGEKPYECKQCGKALSHHSSFRSHMIMHTGDGPHKCKVCGKAFIYPSVFQGHERTHTGEKPYECKECGKAFRISSSLRRHETTHTGEKPYKCKCGKAFIDFYSFQNHETTHTGEKPYECKECGKAFSCFTYLSQHRRTHMAEKPYECKTCKKAFSHFGNLKVHERIHTGEKPYECKECRKAFSWLTCLLRHERIHTGKKSYECQQCGKAFTRSRFLRGHEKTHTGEKMHECKECGKALSSLSSLHRHKRTHWRDTL

SEQ ID NO: 16170 - protein, 671 aa, Homo Sapiens
MASVALEDVAVNFTREEWALLGPCQKNLYKDVMQETIRNLDCVVMKWKDQNIEDQYRYPRKNLRCRMLERFVESKDGTQCGETSSQIQDSIVTKNTLPGVGPCESSMRGEKVMGHSSLNCYIRVGAGHKPHEYHECGEKPDTHKQRGKAFSYHNSFQTHERLHTGKKPYDCKECGKSFSSLGNLQRHMAVQRGDGPYKCKLCGKAFFWPSLLHMHERTHTGEKPYECKQCSKAFSFYSSYLRHERTHTGEKPYECKQCSKAFPFYSSYLRHERTHTGEKPYKCKQCSKAFPDSSSCLIHERTHTGEKPYTCKQCGKAFSVSGSLQRHETTHSAEKPYACQQCGKAFHHLGSFQRHMIRHTGNGPHKCKICGKGFDCPSSLQSHERTHTGEKPYECKQCGKALSHRSSFRSHMIMHTGDGPHKCKVCGKAFVYPSVFQRHERTHTAEKPYKCKQCGKAYRISSSLRRHETTHTGEKPYKCKLGKACIDFCSFQNHKTTHTGEKPYECKECGKAFSRFRYLSRHKRTHTGEKPYECKTCRKAFGHYDNLKVHERIHSGEKPYECKECGKAFSWLTCFLRHERIHMREKSYECPQCGKAFTHSRFLQGHEKTHTGENPYECKECGKAFASLSSLHRHKKTHWKKTHTGENPYECKECGKAFASLSSLHRHKKTH

SEQ ID NO: 16171 - protein, 327 aa, Homo Sapiens
MEVAVPVKQEAEGLALDSPWHRFRRFHLGDAPGPREALGLLRALCRDWLRPEVHTKEQMLELLVLEQFLSALPADTQAWVCSRQPQSGEEAVALLEELWGPAASPDGSSATRVPQDVTQGPGATGGKEDSGMIPLAGTAPGAEGPAPGDSQAVRPYKQEPSSPPLAPGLPAFLAAPGTTSCPECGKTSLKPAHLLRHRQSHSGEKPHACPECGKAFRRKEHLRRHRDTHPGSPGSPGPALRPLPAREKPHACCECGKTFYWREHLVRHRKTHSGARPFACWECGKGFGRREHVLRHQRIHGRAAASAQGAVAPGPDGGGPFPPWPLG

SEQ ID NO: 16172 - protein, 1031 aa, Homo Sapiens
MPPGRWHAAYPAQAQSSRERGRLQTVKKEEEDESYTPVQAARPQTLNRPGQELFRQLFRQLRYHESSGPLETLSRLRELCRWWLRPDVLSKAQILELLVLEQFLSILPGELRVWVQLHNPESGEEAVALLEELQRDLDGTSWRDPGPAQSPDVHWMGTGALRSAQIWSLASPLRSSSALGDHLEPPYEIEARDFLAGQSDTPAAQMPALFPREGCPGDQVTPTRSLTAQLQETMTFKDVEVTFSQDEWGWLDSAQRNLYRDVMLENYRNMASLVGPFTKPALISWLEAREPWGLNMQAAQPKGNPVAAPTGDDLQSKTNKFILNQEPLEEAETLAVSSGCPATSVSEGIGLRESFQQKSRQKDQCENPIQVRVKKEETNFSHRTGKDSEVSGSNSLDLKHVTYLRVSGRKESLKHGCGKHFRMSSHHYDYKKYGKGLRHMIGGFSLHQRIHSGLKGNKKDVCGKDFSLSSHHQRGQSLHTVGVSFKCSDCGRTFSHSSHLAYHQRLHTQEKAFKCRVCGKAFRWSSNCARHEKIHTGVKPYKCDLCEKAFRRLSAYRLHRETHAKKKFLELNQYRAALTYSSGFDHHLGDQSGEKLFDCSQCRKSFHCKSYVLEHQRIHTQEKPYKCTKCRKTFRWRSNFTRHMRLHEEEKFYKQDECREGFRQSPDCSQPQGAPAVEKTFLCQQCGKTFTRKKTLVDHQRIHTGEKPYQCSDCGKDFAYRSAFIVHKKKHAMKRKPEGGPSFSQDTVFQVPQSSHSKEEPYKCSQCGKAFRNHSFLLIHQRVHTGEKPYKCRECGKAFRWSSNLYRHQRIHSLQKQYDCHESEKTPNVEPKILTGEKRFWCQECGKTFTRKRTLLDHKGIHSGEKRYKCNLCGKSYDRNYRLVNHQRIHSTERPFKCQWCGKEFIGRHTLSSHQRKHTRAAQAERSPPARSSSQDTKLRLQKLKPSEEMPLEDCKEACSQSSRLTGLQDISIGKKCHKCSICGKTFNKSSQLISHKRFHTRERPFKCSKCGKTFRWSSNLARHMKNHIRD

SEQ ID NO: 16173 - protein, 450 aa, Homo Sapiens
MPSPLGPPCLPVMDPETTLEEPETARLRFRGFCYQEVAGPREALARLRELCCQWLQPEAHSKEQMLEMLVLEQFLGTLPPEIQAWVRGQRPGSPEEAAALVEGLQHDPGQLLGWITAHVLKQEVLPAAQKTEEPLGSPHPSGTVESPGEGPQDTRIEGSVQLSCSVKEEPNVDGQEVAPSSPPLAAQSPEGNHGHQEPASTSFHPPRIQEEWGLLDRSQKELYWDAMLEKYGTVVSLGLPPHQPEAQAQSELGMLLTGTGVCRSLRSGNESEGPPGCPEAQPPQGPGPAAWEGLSGAATPAPTVRPGTPPVPTQPTPAETRLEPAATPRKPYTCEQCGRGFDWKSVFVIHHRTHTSGPGVQSPGLATGESTEKPPQGEVAFPHHPRRSLTGPRSYPCEECGCSFSWKSQLVIHRKSHTGQRRHFCSDCGRAFDWKSQLVIHRKGHRPEVP

SEQ ID NO: 16174 - protein, 518 aa, Homo Sapiens; identical to SEQ ID NO: 14436

SEQ ID NO: 16175 - protein, 682 aa, Homo Sapiens
MTKSKEAVTFKDVAVVFSEEELQLLDLAQRKLYRDVMLENFRNVVSVGHQSTPDGLPQLEREEKLWMMKMATQRDNSSGAKNLKEMETLQEVGLRYLPHEELFCSQIWQQITRELIKYQDSVVNIQRTGCQLEKRDDLHYKDEGFSNQSSHLQVHRVHTGEKPYKGEHCVKSFSWSSHLQINQRAHAGEKPYKCEKCDNAFRRFSSLQAHQRVHSRAKSYTNDASYRSFSQRSHLPHHQRVPTGENPYKYEECGRNVGKSSHCQAPLIVHTGEKPYKCEECGVGFSQRSYLQVHLKVHTGKKPYKCEECGKSFSWRSRLQAHERIHTGEKPYKCNACGKSFSYSSHLNIHCRIHTGEKPYKCEECGKGFSVGSHLQAHQISHTGEKPYKCEECGKGFCRASNLLDHQRGHTGEKPYQCDACGKGFSRSSDFNIHFRVHTGEKPYKCEECGKGFSQASNLLAHQRGHTGEKPYKCGTCGKGFSRSSDLNVHCRIHTGEKPYKCERCGKAFSQFSSLQVHQRVHTGEKPYQCAECGKGFSVGSQLQAHQRCHTGEKPYQCEECGKGFCRASNFLAHRGVHTGEKPYRCDVCGKRFRQRSYLQAHQRVHTGERPYKCEECGKVFSWSSYLQAHQRVHTGEKPYKCEECGKGFSWSSSLIIHQRVHADDEGDKDFPSSEDSHRKTR

SEQ ID NO: 16176 - protein, 1061 aa, Homo Sapiens
MGDPGSEIIESVPPAGPEASESTTDENEDDIQFVSEGPLRPVLEYIDLVSSDDEEPSTSYTDENIKRKDHIDYQKDKVALTLARLARHVEVEKQQKEEKNRAFREKIDFQHAHGLQELEFIRGHSDTEAARLCVDQWLKMPGLKTGTINCGTKSSFRRGGHTWVSGKPILCPIMHCNKEFDNGHLLLGHLKRFDHSPCDPTITLHGPFFSSFACVVCYKKFVTQQQYRDHLFDKEATDDGHNNNLLPQIIQCFACPNCFLLFSRKEECSKHMSGKNHFHQSFKLGDNKGIAHPISFPSFAKKLLISLCKDVPFQVKCVACHKTLRSHMELTAHFRVHCRNAGPVAVAEKSITQVAEKFILRGYCPDCNQVFVDETSTQNHKQNSGHKVRVINSVEESVLLYCHSSEGNKDPSSDLHLLLDQSKFSSLKRTMSIKESSSLECIAIPKKKMNLKDKSHEGVACVQKEKSVVKTWFCECNQRFPSEDAVEKHVFSANTMGYKCVVCGKVCDDSGVIRLHMSRIHGGAHLNNFLFWCRTCKKELTRKDTIMAHVTEFHNGHRYFYEMDEVEGETLPSSSTTLDNLTANKPSSAITVIDHSPANSSPRGKWQCRICEDMFDSQEYVKQHCMSLASHKFHRYSCAHCRKPFHKIETLYRHCQDEHDNEIKIKYFCGLCDLIFNVEEAFLSHYEEHHSIDYVFVSEKTETSIKTEDDFPVIETSNQLTCGCRESYICKVNRKEDYSRCLQIMLDKGKLWFRCSLCSATAQNLTDMNTHIHQVHKEKSDEEEQQYVIKCGTCTKAFHDPESAQQHFHRKHCFLQKPSVAHFGSEKSNLYKFTASASHTERKLKQAINYSKSLDMEKGVENDLSYQNIEEEIVELPDLDYLRTMTHIVFVDFDNWSNFFGHLPGHLNQGTFIWGFQGGNTNWKPPLNCKIYNYLNRIGCFFLHPRCSKRKDAADFAICMHAGRLDEQLPKQIPFTILSGDQGFLELENQFKKTQRPAHILNPHHLEGDMMCALLNSISDTTKECDSDDNMGAKNTSIGEEFISTEDVELEEAIRRSLEEM

SEQ ID NO: 16177 - protein, 522 aa, Homo Sapiens
MAVSHLPTMVQESVTFKDVAILFTQEEWGQLSPAQRALYRDVMLENYSNLVSLGLLGPKPDTFSQLEKREVWMPEDTPGGFCLDWMTMPASKKSTVKAEIPEEELDQWTIKERFSSSSHWKCASLLEWQCGGQEISLQRVVLTHPNTPSQECDESGSTMSSSLHSDQSQGFQPSKNAFECSECGKVFSKSSTLNKHQKIHNEKNANQKIHIKEKRYECRECGKAFHQSTHLIHHQRIHTGEKPYECKECGKAFSVSSSLTYHQKIHTGEKPFECNLCGKAFIRNIHLAHHHRIHTGEKPFKCNICEKAFVCRAHLTKHQNIHSGEKPYKCNECGKAFNQSTSFLQHQRIHTGEKPFECNECGKAFRVNSSLTEHQRIHTGEKPYKCNECGKAFRDNSSFARHRKIHTGEKPYRCGLCEKAFRDQSALAQHQRIHTGEKPYTCNICEKAFSDHSALTQHKRIHTREKPYKCKICEKAFIRSTHLTQHQRIHTGEKPYKCNKCGKAFNQTANLIQHQRHHIGEK

SEQ ID NO: 16178 - protein, 562 aa, Homo Sapiens
MAAAWMAPAQESVTFEDVAVTFTQEEWGQLDVTQRALYVEVMLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLECGKDFNRRSHLTRHQRTHNGDKPFVCSECGRTFNRGSHLTRHQRVHSGEKPFVCNECGKAFTYRSNFVLHNKSHNEKKPFACSECGKGFYESTALIQHFIIHTGERPFKCLECGKAFNCRSHLKQHERIHTGEKPFVCSQCGKAFTHYSTYVLHERAHTGEKPFECKECGKAFSIRKDLIRHFNIHTGEKPYECLQCGKAFTRMSGLTRHQWIHTGEKPYVCIQCGKAFCRTTNLIRHFSIHTGEKPYECVECGKAFNRRSPLTRHQRIHTAEKSHEPIQSGNVSCESTDLIQHSIIHTESSPVSAVNMETPSIAAHSSSLDINGFIVEETLPL

SEQ ID NO: 16179 - protein, 563 aa, Homo Sapiens
MAHELVMFRDVAIDVSQEEWECLNPAQRNLYKEVMLENYSNLVSLGLSVSKPAVISSLEQGKEPWMVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAFVHCSQLKHLRIHNGEKRYECNECGKAFNYGSELTLHQRIHTGEKPYECKECGKAFRQRSQLTQHQRLHTGEKPYECKQCGKAFIRGFQLTEHLRLHTGEKPYECKECGKTFRHRSHLTIHQRIHTGEKPYECRECGKAFSYHSSFSHHQKIHSGKKPYECHECGKAFCDGLQLTLHQRIHTGEKPYECKECGKTFRQCSHLKRHQRIHTGEKPHECMICGKAFRLHSHLIQHQRIHTGEKPYECKECGKAFSYHSSFSHHQRIHSGKKPYQCGKAFNHRLQLNLHQTLHTGEKPVRFPLLPPHPSLAS

SEQ ID NO: 16180 - protein, 2506 aa, Homo Sapiens
MEVLQCDGCDFRAPSYEDLKAHIQDVHTAFLQPTDVAEDNVNELRCGSVNASNQTEVEFSSIKDEFAIAEDLSGQNATSLGTGGYYGHSPGYYGQHIAANPKPTNKFFQCKFCVRYFRSKNLLIEHTRKVHGAQAEGSSSGPPVPGSLNYNIMMHEGFGKVFSCQFCTYKSPRRARIIKHQKMYHKNNLKETTAPPPAPAPMPDPVVPPVSLQDPCKELPAEVVERSILESMVKPLTKSRGNFCCEWCSYQTPRRERWCDHMMKKHRSMVKILSSLRQQQEGTNLPDVPNKSAPSPTSNSTYLTMNAASREIPNTTVSNFRGSMGNSIMRPNSSASKFSPMSYPQMKPKSPHNSGLVNLTERSRYGMTDMTNSSADLETNSMLNDSSSDEELNEIDSENGLSAMDHQTSGLSAEQLMGSDGNKLLETKGIPFRRFMNRFQCPFCPFLTMHRRSISRHIENIHLSGKTAVYKCDECPFTCKSSLKLGAHKQCHTGTTSDWDAVNSQSESISSSLNEGVVSYESSSINGRKSGVMLDPLQQQQPPQPPPPPPPPPPSQPQPLQQPQPPQLQPPHQVPPQPQTQPPPTQQPQPPTQAAPLHPYKCTMCNYSTTTLKGLRVHQQHKHSFCDNLPKFEGQPSSLPLENETDSHPSSSNTVKKSQTSILGLSSKNNFVAKASRKLANDFPLDLSPVKKRTRIDEIASNLQSKINQTKQQEDAVINVEDDEEEEEDNEVEIEVELDREEEPTEPIIEVPTSFSAQQIWVRDTSEPQKEPNFRNITHDYNATNGAEIELTLSEDEEDYYGSSTNLKDHQVSNTALLNTQTPIYGTEHNSENTDFGDSGRLYYCKHCDFNNKSARSVSTHYQRMHPYIKFSFRYILDPNDHSAVYRCLECYIDYTNFEDLQQHYGEHHPEAMNVLNFDHSDLIYRCRFCSYTSPNVRSLMPHYQRMHPTVKINNAMIFSSYVVEQQEGLNTESQTLREILNSAPKNMATSTPVARGGGLPATFNKNTPKTFTPECENQKDPLVNTVVVYDCDVCSFASPNMHSVLVHYQKKHPEEKASYFRIQKTMRMVSVDRGSALSQLSFEVGAPMSPKMSNMGSPPPPQPPPPDLSTELYYCKHCSYSNRSVVGVLVHYQKRHPEIKVTAKYIRQAPPTAAMMRGVEGPQGSPRPPAPIQQLNRSSSERDGPPVENEMFFCQHCDYGNRTVKGVLIHYQKKHRDFKANADVIRQHTATIRSLCDRNQKKPASCVLVSPSNLERDKTKLRALKCRQCSYTSPYFYALRKHIKKDHPALKATVTSIMRWAFLDGLIEAGYHCEWCIYSHTEPNGLLLHYQRRHPEHYVDYTYMATKLWAGPDPSPPSLTMPAEAKTYRCRDCVFEAVSIWDITNHYQAFHPWAMNGDESVLLDIIKEKDAVEKPILSSEELAGPVNCENSIPTPFPEQEAECPEDARLSPEKSLQLASANPAISSTPYQCTVCQSEYNNLHGLLTHYGKKHPGMKVKAADFAQDIDINPGAVYKCRHCPYINTRIHGVLTHYQKRHPSIKVTAEDFVHDVEQSADISQNDVEETSRIFKQGYGAYRCKLCPYTHGTLEKLKIHYEKYHNQPEFDVFSQSPPKLPVPLEPEMTTEVSPSQVSITEEEVGEEPVSTSHFSTSHLVSHTVFRCQLCKYFCSTRKGIARHYRIKHNNVRAQPEGKNNLFKCALCAYTNPIRKGLAAHYQKRHDIDAYYTHCLAASRTISDKPNKVIIPSPPKDDSPQLSEELRRAVEKKKCSLCSFQSFSKKGIVSHYMKRHPGVFPKKQHASKLGGYFTAVYADEHEKPTLMEEEERGNFEKAEVEGEAQEIEWLPFRCIKCFKLSFSTAELLCMHYTDHHSRDLKRDFIILGNGPRLQNSTYQCKHCDSKLQSTAELTSHLNIHNEEFQKRAKRQERRKQLLSKQKYADGAFADFKQERPFGHLEEVPKIKERKVVGYKCKFCVEVHPTLRAICNHLRKHVQYGNVPAVSAAVKGLRSHERSHLALAMFTREDKYSCQYCSFVSAFRHNLDRHMQTHHGHHKPFRCKLCSFKSSYNSRLKTHILKAHAGEHAYKCSWCSFSTMTISQLKEHSLKVHGKALTLPRPRIVSLLSSHSHHSSQKATPAEEVEDSNDSSYSEPPDVQQQLNHYQSAALARNNSRVSPVPLSGAAAGTEQKTEAVLHCEFCEFSSGYIQSIRRHYRDKHGGKKLFKCKDCSFYTGFKSAFTMHVEAGHSAVPEEGPKDLRCPLCLYHTKYKRNMIDHIVLHREERVVPIEVCRSKLSKYLQGVVFRCDKCTFTCSSDESLQQHIEKHNELKPYKCQLCYYETKHTEELDSHLRDEHKVSRNFELVGRVNLDQLEQMKEKMESSSSDDEDKEEEMNSKAEDRELMRFSDHGAALNTEKRFPCEFCGRAFSQGSEWERHVLRHGMALNDTKQVSREEIHPKEIMENSVKMPSIEEKEDDEAIGIDFSLKNETVAICVVTADKSLLENAEAKKE

SEQ ID NO: 16181 - protein, 595 aa, Homo Sapiens
MRETLEALSSLGFSVGQPEMAPQSEPREGSHNAQEQMSSSREERALGVCSGHEAPTPEEGAHTEQAEAPCRGQACSAQKAQPVGTCPGEEWMIRKVKVEDEDQEAEEEVEWPQHLSLLPSPFPAPDLGHLAAAYKLEPGAPGALSGLALSGWGPMPEKPYGCGECERRFRDQLTLRLHQRLHRGEGPCACPDCGRSFTQRAHMLLHQRSHRGERPFPCSECDKRFSKKAHLTRHLRTHTGERPYPCAECGKRFSQKIHLGSHQKTHTGERPFPCTECEKRFRKKTHLIRHQRIHTGERPYQCAQCARSFTHKQHLVRHQRVHQTAGPARPSPDSSASPHSTAPSPTPSFPGPKPFACSDCGLSFGWKKNLATHQCLHRSEGRPFGCDECALGATVDAPAAKPLASAPGGPGCGPGSDPVVPQRAPSGERSFFCPDCGRGFSHGQHLARHPRVHTGERPFACTQCDRRFGSRPNLVAHSRAHSGARPFACAQCGRRFSRKSHLGRHQAVHTGSRPHACAVCARSFSSKTNLVRHQAIHTGSRPFSCPQCGKSFSRKTHLVRHQLIHGEAAHAAPDAALAAPAWSAPPEVAPPPLFF

SEQ ID NO: 16182 - protein, 522 aa, Homo Sapiens
MALPQGLLTFRDVAIEFSQEEWKCLDPAQRTLYRDVMLENYRNLVSLDISSKCMLKTLSSTGQGNTEVIHTGTLHRQASHHIGEFCFHEIEKDIHGFEFQWKEDETNGHAAPMTEIKELAGSTGQHDQRHAGNKRIKDQLGSSFHLHLPEPHIFQSEGKIGNQVEKSINNASSVSTSQRICCRPKTHISNKYGNNSLHSSLLTQKWEVHMREKSFECIQSFKSFNCSSLLKKHQIIHLEEKQCKCDVCGKVFNQKRYLACHRRCHTGEKPYKCNECGKTFGHNSSLFIHKALHTGEKPYECEECDKVFSRKSHLERHKRIHTGEKPYKCKVCDEAFAYNSYLAKHTILHTGEKPYTCNECGKVFNRLSTLARHHRLHTGEKPYKCEECDKVFSRKSHLERHRRIHSGEKPYKCEECCKVFSRKSNLERHRRIHTGEKPYKCKVCDKAFQRDSHLAQHQRVHTGEKPYKCNECGKTFGQTSSLIIHRRLHTGEKPYKCNECGKTFSQMSSLVYHHRLHSGEKP

SEQ ID NO: 16183 - protein, 3925 aa, Homo Sapiens
MPGERPRGAPPPTMTGDLQPRQVASSPGHPSQPPLEDNTPATRTTKGAREAGGQAQAMELPEAQPRQARDGELKPPSLRGQAPSSTPGKRGSPQTPPGRSPLQAPSRLAGRAEGSPPQRYILGIASSRTKPTLDETPENPQLEAAQLPEVDTPQGPGTGAPLRPGLPRTEAQPAAEELGFHRCFQEPPSSFTSTNYTSPSATPRPPAPGPPQSRGTSPLQPGSYPEYQASGADSWPPAAENSFPGANFGVPPAEPEPIPKGSRPGGSPRGVSFQFPFPALHGASTKPFPADVAGHAFTNGPLVFAFHQPQGAWPEEAVGTGPAYPLPTQPAPSPLPCYQGQPGGLNRHSDLSGALSSPGAAHSAPRPFSDSLHKSLTKILPERPPSAQDGLGSTRGPPSSLPQRHFPGQAYRASGVDTSPGPPDTELAAPGPPPARLPQLWDPTAAPYPTPPGGPLAATRSMFFNGQPSPGQRLCLPQSAPLPWPQVLPTARPSPHGMEMLSRLPFPAGGPEWQGGSQGALGTAGKTPGPREKLPAVRSSQGGSPALFTYNGMTDPGAQPLFFGVAQPQVSPHGTPSLPPPRVVGASPSESPLPSPATNTAGSTCSSLSPMSSSPANPSSEESQLPGPLGPSAFFHPPTHPQETGSPFPSPEPPHSLPTHYQPEPAKAFPFPADGLGAEGAFQCLEETPFPHEGPEVGRGGLQGFPRAPPPYPTHHFSLSSASLDQLDVLLTCRQCDRNYSSLAAFLAHRQFCGLLLARAKDGHQRSPGPPGLPSPPAAPRVPADAHAGLLSHAKTFLLAGDAQAEGKDDPLRTGFLPSLAATPFPLPASDLDMEDDAKLDSLITEALNGMEYQSDNPEIDSSFIDVFADEEPSGPRGPSSGHPLKSKAGVTPESKAPPPLPAATPDPQTPRPGDRGCPARGRPKTRSLGLAPTEADAPSQGRQQRRGKQLKLFRKDLDSGGAAEGSGSGGGGRASGLRPRRNDGLGERPPPRPRRPRTQAPGSRADPAPRVPRAAALPEETRSSRRRRLPPRKDPRKRKARGGAWGKELILKIVQQKNRLREYDFASESEEDEQPPPRGPGFRGRRGRGEKRKEVELTQGPREDEPQKPRKAARQEAGGDGAPANPEEPGGSRPGPGRSPQARGPSRSLETGAAAREGGPKCADRPSVAPKDPLQVPTNTETSEETRPSLDFPQEAKEPETAEESAPDSTEFTEALRSPPAACAGEMGASPGLLIPEQPPPSRHDTGTPKPSGSLANTAPHGSSPTPGVGSLLGGPGGTQAPVSHNSKDPPARQPGEFLAPVANPSSTACPKPSVLSSKISSFGCDPAGFNRDPLGVPVAKKGPQPYSSPHSELFLGPKDLAGCFLEELHPKPSARDAPPASSSCLCQDGEDAGSLEPQLPRSPPGTAETEPGRAASPPTLESSSLFPDLPVDRFDPPLYGSLSANRDSGLPFACADPPQKTVPSDPPYPSFLLLEEVSPMLPSHFPDLSGGKVLSKTCPPERTVVPGAAPSLPGKGSGCSVALMSHLSEDELEIQKLVTELESQLQRSKDTRGAPRELAEAESVGRVELGTGTEPPSQRRTCQATVPHEDTFSAADLTRVGESTAHREGAESAVATVEAVQGRPGGTWPCPASFHPGHAALLPCAQEDLVSGAPFSPRGANFHFQPVQKAGASKTGLCQAEGDSRPPQDVCLPEPSKQPGPQLDAGSLAKCSPDQELSFPKNKEAASSQESEDSLRLLPCEQRGGFLPEPGTADQPHRGAPAPEAFGSPAVHLAPDLAFQGDGAPPLDATWPFGASPSHAAQGHSAGRAGGHLHPTAGRPGFEGNEFAPAGASSLTAPRGREAWLVPVPSPACVSNTHPSRRSQDPALSPPIRQLQLPGPGVAKSKDGILGLQELTPAAQSPPRVNPSGLEGGTVEGGKVACGPAQGSPGGVQVTTLPAVAGHQLGLEADGHWGLLGQAEKTQGQGTANQLQPENGVSPGGTDNHASVNASPKTALTGPTEGAVLLEKCKGSRAAMSLQEEAEPTPSPPSPNRESLALALTAAHSRSGSEGRTPERASSPGLNKPLLATGDSPAPSVGDLAACAPSPTSAAHMPCSLGPLPREDPLTSPSRAQGGLGGQLPASPSCRDPPGPQQLLACSPAWAPLEEADGVQATTDTGAEDSPVAPPSLTTSPCDPKEALAGCLLQGEGSPLEDPSSWPPGSVSAVTCTHSGDTPKDSTLRIPEDSRKEKLWESPGRATSPPLAGAVSPSVAVRATGLSSTPTGDEAQAGRGLPGPDPQSRGAPPHTNPDRMPRGHSSYSPSNTARLGHREGQAVTAVPTEPPTLQGAGPDSPACLEGEMGTSSKEPEDPGTPETGRSGATKMPRVTCPSTGLGLGRTTAPSSTASDFQSDSPQSHRNASHQTPQGDPLGPQDLKQRSRGYKKKPASTENGQWKGQAPHGPVTCEVCAASFRSGPGLSRHKARKHRPHPGAPAEPSPAALPAQQPLEPLAQKCQPPRKKSHRVSGKERPNHSRGDPSHVTQPPPAQGSKEVLRAPGSPHSQQLHPPSPTEHEVDVKTPASKPRPDQAREDELHPKQAEKREGRRWRREPTVDSPSHSEGKSNKKRGKLRGRRLREESILPVSADVISDGRGSRPSPAMASYAASPSHCLSVEGGPEADGEQPPRLATLGPGVMEGAAETDQEALCAGETGAQKPPGDRMLCPGRMDGAALGEQPTGQKGASARGFWGPRETKALGVCKESGSEPAEDSSRAHSRSEEGVWEENTPPLGPLGFPETSSSPADSTTSSCLQGLPDNPDTQGGVQGPEGPTPDASGSSAKDPPSLFDDEVSFSQLFPPGGRLTRKRNPHVYGKRCEKPVLPLPTQPSFEEGGDPTLGPARLPTDLSDSSSLCLCHEDPWEDEDPAGLPESFLLDGFLNSRVPGIDPWAPGLSLWALEPSREAGAEKLPSHCPEDDRPEAIPELHMVPAAWRGLEMPAPADDSSSSLGDVSPEPPSLERERCDGGLPGNTHLLPLRATDFEVLSTKFEMQDLCFLGPFEDPVGLPGPSFLDFEGTASSQGPQSRRTEEAAGAGRAQGRGRPAKGRRASYKCKVCFQRFRSLGELDLHKLAHTPAPPPTCYMCVERRFGSRELLRGHLQERHAQSKAGPWACGMCLKEVADVWMYNEHLREHAVRFARRGQARRSLGDLPGGLEGSSAVAHLLNSITEPAPKHHRGKRSAGKAAGSPGDPWGQEGEAKKDSPGERAKPRARSTPSNPDGAATPDSASATALADAGSPGPPRTTPSPSPDPWAGGEPLLQATPVHEACKDPSRDCHHCGKRFPKPFKLQRHLAVHSPQRVYLCPRCPRVYPEHGELLAHLGGAHGLLERPELQHTPLYACELCATVMRIIKKSFACSSCNYTFAKKEQFDRHMNKHLRGGRQPFAFRGVRRPGAPGQKARALEGTLPSKRRRVAMPGSAPGPGEDRPPPRGSSPILSEGSLPALLHLCSEVAPSTTKGWPETLERPVDPVTHPIRGCELPSNHQECPPPSLSPFPAALADGRGDCALDGALERPENEASPGSPGPLLQQALPLGASLPRPGARGQDAEGKRAPLVFSGKRRAPGARGRCAPDHFQEDHLLQKEKEVSSSHMVSEGGPRGTFHKGSATKPAGCQSSSKDRSAASTPSKALKFPVHPRKAVGSLAPGELARGTENGMKPATPKAKPGPSSQGSGSPRPGTKTGGGSQPQPASGQLQSETATTPAKPSFPSRSPAPERLPARAQAKSCTKGPREAGEQGPHGSLGPKEKGESSTKRKKGQVPGPARSESVGSFGRAPSAPDKPPRTPRKQATPSRVLPTKPKPNSQNKPRPPPSEQRKAEPGHTQRKDRLGKAFPQGRPLLRPPKRGTAVHGAEPAEPHTHRTAEAQSDLLSQLFGQRLTGFKIPLKKDASE

SEQ ID NO: 16184 - protein, 717 aa, Homo Sapiens
MKSQEEVEVAGIKLCKAMSLGSVTFTDVAIDFSQDEWEWLNLAQRSLYKKVMLENYRNLVSVGLCISKPDVISLLEQEKDPWVIKGGMNRGLCPDLECVWVTKSLSLNQDIYEEKLPPAIIMERLKSYDLECSTLGKNWKCEDLFERELVNQKTHFRQETITHIDTLIEKRDHSNKSGTVFHLNTLSYIKQIFPMEERIFNFHTDKKSLKTHSVVKKHKQDRGEKKLLKCNDCEKIFSKISTLTLHQRIHTGEKPYECIECGKAFSQSAHLAQHQRIHTGEKPFECTECGKAFSQNAHLVQHQRVHTGEKPYQCKQCNKAFSQLAHLAQHQRVHTGEKPYECIECGKAFSDCSSLAHHRRIHTGKRPYECIDCGKAFRQNASLIRHRRYYHTGEKPFDCIDCGKAFTDHIGLIQHKRTHTGERPYKCNVCGKAFSHGSSLTVHQRIHTGEKPYECNICEKAFSHRGSLTLHQRVHTGEKPYECKECGKAFRQSTHLAHHQRIHTGEKPYECKECSKTFSQNAHLAQHQKIHTGEKPYECKECGKAFSQIAHLVQHQRVHTGEKPYECIECGKAFSDGSYLVQHQRLHSGKRPYECLECGKAFRQRASLICHQRCHTGEKPYECNVCGKAFSHRKSLTLHQRIHTGEKPYECKECSKAFSQVAHLTLHKRIHTGERPYECKECGKAFRQSVHLAHHQRIHTGESSVILSSALPYHQVL

SEQ ID NO: 16185 - protein, 626 aa, Homo Sapiens
MNVEVVKVMPQDLVTFKDVAIDFSQEEWQWMNPAQKRLYRSMMLENYQSLVSLGLCISKPYVISLLEQGREPWEMTSEMTRSPFSDWESIYVTQELPLKQFMYDDACMEGITSYGLECSTFEENWKWEDLFEKQMGSHEMFSKKEIITHKETITKETEFKYTKFGKCIHLENIEESIYNHTSDKKSFSKNSMVIKHKKVYVGKKLFKCNECDKTFTHSSSLTVHFRIHTGEKPYACEECGKAFKQRQHLAQHHRTHTGEKLFECKECRKAFKQSEHLIQHQRIHTGEKPYKCKECRKAFRQPAHLAQHQRIHTGEKPYECKECGKAFSDGSSFARHQRCHTGKRPYECIECGKAFRYNTSFIRHWRSYHTGEKPFNCIDCGKAFSVHIGLILHRRIHTGEKPYKCGVCGKTFSSGSSRTVHQRIHTGEKPYECDICGKDFSHHASLTQHQRVHSGEKPYECKECGKAFRQNVHLVSHLRIHTGEKPYECKECGKAFRISSQLATHQRIHTGEKPYECIECGNAFKQRSHLAQHQKTHTGEKPYECNECGKAFSQTSNLTQHQRIHTGEKPYKCTECGKAFSDSSSCAQHQRLHTGQRPYQCFECGKAFRRKLSLICHQRSHTGEEP

SEQ ID NO: 16186 - protein, 871 aa, Homo Sapiens
MAEEFVTLKDVGMDFTLGDWEQLGLEQGDTFWDTALDNCQDLFLLDPPRPNLTSHPDGSEDLEPLAGGSPEATSPDVTETKNSPLMEDFFEEGFSQEIIEMLSKDGFWNSNFGEACIEDTWLDSLLGDPESLLRSDIATNGESPTECKSHELKRGLSPVSTVSTGEDSMVHNVSEKTLTPAKSKEYRGEFFSYSDHSQQDSVQEGEKPYQCSECGKSFSGSYRLTQHWITHTREKPTVHQECEQGFDRNASLSVYPKTHTGYKFYVCNEYGTTFSQSTYLWHQKTHTGEKPCKSQDSDHPPSHDTQPGEHQKTHTDSKSYNCNECGKAFTRIFHLTRHQKIHTRKRYECSKCQATFNLRKHLIQHQKTHAAKTTSECQECGKIFRHSSLLIEHQALHAGEEPYKCNERGKSFRHNSTLKIHQRVHSGEKPYKCSECGKAFHRHTHLNEHRRIHTGYRPHKCQECVRSFSRPSHLMRHQAIHTAEKPYSCAECKETFSDNNRLVQHQKMHTVKTPYECQECGERFICGSTLKCHESVHAREKQGFFVSGKILDQNPEQKEKCFKCNKCEKTFSCSKYLTQHERIHTRGVKPFECDQCGKAFGQSTRLIHHQRIHSRVRLYKWGEQGKAISSASLIKLQSFHTKEHPFKCNECGKTFSHSAHLSKHQLIHAGENPFKCSKCDRVFTQRNYLVQHERTHARKKPLVCNECGKTFRQSSCLSKHQRIHSGEKPYVCDYCGKAFGLSAELVRHQRIHTGEKPYVCQECGKAFTQSSCLSIHRRVHTGEKPYRCGECGKAFAQKANLTQHQRIHTGEKPYSCNVCGKAFVLSAHLNQHLRVHTQETLYQCQRCQKAFRCHSSLSRHQRVHNKQQYCL

SEQ ID NO: 16187 - protein, 364 aa, Homo Sapiens
MERGKKKRISNKLQQTFHHSKEPTFLINQAGLLSSDSYSSLSPETESVNPGENIKTDTQKKRPGTVILSKLSSRRIISESQLSPPVIPARRPGFRVCYICGREFGSQSIAIHEPQCLQKWHIENSKLPKHLRRPEPSKPQSLSSSGSYSLQATNEAAFQSAQAQLLPCESCGRTFLPDHLLVHHRSCKPKGEGPRAPHSNSSDHLTGLKKACSGTPARPRTVICYICGKEFGTLSLPIHEPKCLEKWKMENDRLPVELHQPLPQKPQPLPNAQSSQAGPNQAQLVFCPHCSRIFTSDRLLVHQRSCKTHPYGPKYQNLNLGSKGGLKEYTNSKQQRNRAAPSVTDKVIHATQDALGEPGGALCL

SEQ ID NO: 16188 - protein, 1883 aa, Homo Sapiens; identical to SEQ ID NO: 15972

SEQ ID NO: 16189 - protein, 524 aa, Homo Sapiens
MAKRPGPPGSREMGLLTFRDIAIEFSLEEWQCLDCAQRNLYRDVMLENYRNLVSLGIAVSKPDLITCLEQNKESQNIKRNEMVAKHPVTRSHFTQDLQPEQGIKDSLQKVIPRTYGKCGHEKLQFKKCCKSVGEYEVHKGGYSEVNQCLSTTQNKIFQTHKYVKVFGKFSNSNRDKTRYTGNKHFKCNKYGKSFCMLSHLNQHQVIHTREKSYKCKECGKSFNCSSNHTTHKIIHTGEKPYRCEECGKAFSWSANLTRHKRTHTGEKPYTCEECGQAFRRSSALTNHKRIHTGERPYKCEECGKAFSVSSTLTDHKRIHTGEKPCRCEECGKAFSWSSNLTRHKRIHTREKPYACEECGQAFSLSSNLMRHRRIHTGEKPYTCEECGQDFRRSSALTIHKRIHTGERPYKCEECGKVFSLSSTLTDHKRIHTGERPYKCEECGKAFSLSSTLTDHKRIHTGERPYTCEECGKAFNCSSTLMQHKRIHTGEKPYKCEECEQAFKWHSSLAKHKIIHTGEKPYKCE

SEQ ID NO: 16190 - protein, 618 aa, Homo Sapiens
MERAVEPWGPDLHRPEEREPQRGARTGLGSENVISQPNEFEHTPQEDDLGFKEEDLAPDHEVGNASLKPEGIQNWDDLWVQREGLGKPQPRDRGPRLLGEPRWGQASSDRAAVCGECGKSFRQMSDLVKHQRTHTGEKPYKCGVCGKGFGDSSARIKHQRTHSGEKPYRARPPAQGPPKIPRSRIPAGERPTICGECGKSFRQSSDLVKHQRTHTGEKPYKCGICGKGFGDSSARIKHQRTHRGEQPPRPVVPRRQPSRAATAATQGPKAQDKPYICTDCGKRFVLSCSLLSHQRSHLGPKPFGCDVCGKEFARGSDLVKHLRVHTGEKPYLCPECGKGFADSSARVKHLRTHSGERPHACPECDRTFSLSSTLLRHRLTHMEPQDFSFPGYPLPALIPSPPPPPLGTSPPLTPRSPSHSGEPFGLPGLEPEPGGPQAGEPPPPLAGDKPHKCPECGKGFRRSSDLVKHHRVHTGEKPYLCPECGKGFADSSARVKHLRTHRGERARPPPPSTLLRPHNPPGPVPMAPRPRVRAQPSGPSQPHVCGFCGKEFPRSSDLVKHRRTHTGEKPYKCAECGKGFGDSSARIKHQRGHLVLTPFGIGDGRARPLKQEAATGLE

SEQ ID NO: 16191 - protein, 535 aa, Homo Sapiens
MLCDEKAQKRRKRKAKESGMALPQGHLTFRDVAIEFSQAEWKCLDPAQRALYKDVMLENYRNLVSLGISLPDLNINSMLEQRREPWSGESEVKIAKNSDGRECIKGVNTGSSYALGSNAEDKPIKKQLGVSFHLHLSELELFPDERVINGCNQVENFINHSSSVSCLQEMSSSVKTPIFNRNDFDDSSFLPQEQKVHLREKPYECNEHSKVFRVSSSLTKHQVIHTVEKPYKCNSCGKVFSRNSHLAEHCRIHTGEKPYKCNVCGKVFSYNSNFARHQRIHTREKPYECNECGKVFSNNSYLARHQRIHAEEKPYKCNECGKGFSHKSSLANHWRIYTGEKPYKCDECGKAFYRIALLVRHQKIHTGEKPYKCNECGKVFIQNSHLAQHWRIHTGEKPYKCNECGKVFNQLSNLARHRRIHTGEKPYKCNECGKAFSEYSGLSAHLVIHTGEKPYKCSECGKAFRHKLSLTNHQRIHTGERPYKCNECGKVFNRIAHLARHRKIHTGEKPYKCNECGKAFSRISYLAQHWTIHMG

SEQ ID NO: 16192 - protein, 744 aa, Homo Sapiens
MQAVVPLNKMTAISPEPQTLASTEQNEVPRVVTSGEQEAILRGNAADAESFRQRFRWFCYSEVAGPRKALSQLWELCNQWLRPDIHTKEQILELLVFEQFLTILPGEIRIWVKSQHPESSEEVVTLIEDLTQMLEEKDPVSQDSTVSQEENSKEDKMVTVCPNTESCESITLKDVAVNFSRGEWKKLEPFQKELYKEVLLENLRNLEFLDFPVSKLELISQLKWVELPWLLEEVSKSSRLDESALDKIIERCLRDDDHGLMEESQQYCGSSEEDHGNQGNSKGRVAQNKTLGSGSRGKKFDPDKSPFGHNFKETSDLIKHLRVYLRKKSRRYNESKKPFSFHSDLVLNRKEKTAGEKSRKSNDGGKVLSHSSALTEHQKRQKIHLGDRSQKCSKCGIIFIRRSTLSRRKTPMCEKCRKDSCQEAALNKDEGNESGEKTHKCSKCGKAFGYSASLTKHRRIHTGEKPYMCNECGKAFSDSSSLTPHHRTHSGEKPFKCDDCGKGFTLSAHLIKHQRIHTGEKPYKCKDCGRPFSDSSSLIQHQRIHTGEKPYTCSNCGKSFSHSSSLSKHQRIHTGEKPYKCGECGKAFRQNSCLTRHQRIHTGEKPYLCNDCGMTFSHFTSVIYHQRLHSGEKPYKCNQCEKAFPTHSLLSRHQRIHTGVKPYKCKECGKSFSQSSSLNEHHRIHTGEKPYECNYCGATFSRSSILVEHLKIHTGRREYECNECEKTFKSNSGLIRHRGFHSAE

SEQ ID NO: 16193 - protein, 852 aa, Homo Sapiens
MTKSLESVSFKDVTVDFSRDEWQQLDLAQKSLYREVMLENYFNLISVGCQVPKPEVIFSLEQEEPCMLDGEIPSQSRPDGDIGFGPLQQRMSEEVSFQSEININLFTRDDPYSILEELWKDDEHTRKCGENQNKPLSRVVFINKKTLANDSIFEYKDIGEIVHVNTHLVSSRKRPHNCNSCGKNLEPIITLYNRNNATENSDKTIGDGDIFTHLNSHTEVTACECNQCGKPLHHKQALIQQQKIHTRESLYLFSDYVNVFSPKSHAFAHESICAEEKQHECHECEAVFTQKSQLDGSQRVYAGICTEYEKDFSLKSNRQKTPYEGNYYKCSDYGRAFIQKSDLFRCQRIHSGEKPYEYSECEKNLPQNSNLNIHKKIHTGGKHFECTECGKAFTRKSTLSMHQKIHTGEKPYVCTECGKAFIRKSHFITHERIHTGEKPYECSDCGKSFIKKSQLHVHQRIHTGENPFICSECGKVFTHKTNLIIHQKIHTGERPYICTVCGKAFTDRSNLIKHQKIHTGEKPYKCSDCGKSFTWKSRLRIHQKCHTGERHYECSECGKAFIQKSTLSMHQRIHRGEKPYVCTECGKAFFHKSHFITHERIHTGEKPYECSICGKSFTKKSQLHVHQQIHTGEKPYRCAECGKAFTDRSNLFTHQKIHTGEKPYKCSDCGKAFTRKSGLHIHQQSHTGERHYECSECGKAFARKSTLIMHQRIHTGEKPYICNECGKSFIQKSHLNRHRRIHTGEKPYECSDCGKSFIKKSQLHEHHRIHTGEKPYICAECGKAFTIRSNLIKHQKIHTKQKPYKCSDLGKALNWKPQLSMPQKSDNGEVECSMPQLWCGDSEGDQGQLSSI

SEQ ID NO: 16194 - protein, 441 aa, Homo Sapiens
MAPRAQIQGPLTFGDVAVAFTRIEWRHLDAAQRALYRDVMLENYGNLVSVGLLSSKPKLITQLEQGAEPWTEVREAPSGTHAVEDYWFETKMSALKQSTSEASVLGERTKSVMMEKGLDWEGRSSTEKNYKCKECGKVFKYNSSFISHQRNHTSEKPHKCKECGIAFMNSSSLLNHHKVHAGKQPYRCIECGKFLKKHSTFINHQRIHSREKPHKCIECGKTFRKNSILLSHQRIHTGQKPYKCNDCGKAFAQNAALTRHERIHSGEKPFKCNKCGRAFRDNSTVLEHQKIHTGEKPYQCNECGKAFRKSSTLISHQRMHTGEKPYHCSKCGKSFRYSSSFAGHQKTHSGNKPYQCRDCGKAFTKSSTLTGHQRIHTGEKPYHCKKCGKAFRHSSGLVEHQRLHTGEKPYKCNECGKAFPRSSALKQHKKIHNKERAMKCS

SEQ ID NO: 16195 - protein, 463 aa, Homo Sapiens
MPGPLRSLEMESLQFRDVAVEFSLEEWHCLDTAQQNLYRDVMLENYRHLVFLGIIVSKPDLITCLEQGIKPLTMKRHEMIAKPPVVCSHFAQDLWPEQSIKDSYQKVILRKFEKCGHGNLHFKKGCESVDECKLHKRGYNGLNQCLTTTQSKIFQCGKYVKVFHQFSNSKRHKRRHTEKKPLKYIEGDKAFNQSSTHTTHKKIDTGEKPYKCEECGKAFNRSSHLTTHKITHTREKPYKCEECGKVFKYFSSFTTHKKIHSGEKPYICEECGKAFMYPYTLTTHKIIHTGEQPYKCKECDKAFNHPATLSSHKKIHTGEKPYTCDKCGKAFISSSILSKHEKIHTGEKPYKCEECGKAFTRSSHLTMHKIIHTGEKPYKCEECGKAFTWSAGLHKHRRTHTGEKPYKCEECGKAYTTSSNLTEHKTTHTGEKPYKCKECGKAFNWSSDLNKHKRIHIGQKPRT

SEQ ID NO: 16196 - protein, 448 aa, Homo Sapiens [sequence omitted]

SEQ ID NO: 16197 - protein, 340 aa, Homo Sapiens; identical to SEQ ID NO: 14439

SEQ ID NO: 16198 - protein, 529 aa, Homo Sapiens
MRRNSSLSFQMERPLEEQVQSKWSSSQGRTGTGGSDVLQMQNSEHHGQSIKTQTDSISLEDVAVNFTLEEWALLDPGQRNIYRDVMRATFKNLACIGEKWKDQDIEDEHKNQGRNLRSPMVEALCENKEDCPCGKSTSQIPDLNTNLETPTGLKPCDCSVCGEVFMHQVSLNRHMRSHTEQKPNECHEYGEKPHKCKECGKTFTRSSSIRTHERIHTGEKPYECKECGKAFAFLFSFRNHIRIHTGETPYECKECGKAFRYLTALRRHEKNHTGEKPYKCKQCGKAFIYYQPFLTHERTHTGEKPYECKQCGKAFSCPTYLRSHEKTHTGEKPFVCRECGRAFFSHSSLRKHVKTHTGVQPYTCKKCGEAFKSSSSCEVHERTHFGEKPYECKQCGKAFNSSSYLQLHERVHTGEKTYECKECGKAFLYSTHFRIHERTHTREKPYECKQCGRVFIYFSHLRRHERSHTGVKPCECKQCGKAFTCLNSLKVHKRIHTGERPFQCRQCGKAFSYSKSLHVHERTHSRQKP

SEQ ID NO: 16199 - protein, 437 aa, Homo Sapiens
MGERLFESAEGSQCGETFTQVPEDMLNKKTLPGVKSCESGTCGEIFMGYSSFNRNIRTDTGHQPHKCQKFLEKPYKHKQRRKALSHSHCFRTHERPHTREKPFDCKECEKSFISPASIRRYMVTHSGDGPYKCKFCGKALDCLSLYLTHERTHTGEKRYECKQCGKAFSWHSSVRIHERTHTGEKPYECKECGKSFNFSSSFRRHERTHTGEKPYKCKECGKAFNCPSSFHRHERTHTGEKPYECKLYGKALSRLISFRRHMRMHTGERPHKCKICGKAFYSPSSFQRHERSHTGEKPYKCKQCGKAFTCSTSFQYHERTHTGEKPDGCKQCGKAFRSAKYIRIHGRTHTGEKPYECKQCGKAFHCVSSFHRHERTHAGEKPYECKHCGKAFTCSIYIRIHERIHTGEKPYQCKECGKAFIRSSYCRKHERTHTINI

SEQ ID NO: 16200 - protein, 531 aa, Homo Sapiens
MLENYRNLVFVGIAASKPDLITCLEQGKEPWNVKRHEMVAEPPVVCSYFARDLWPKQGKKNYFQKVILRRYKKCGCENLQLRKYCKSMDECKVHKECYNGLNQCLTTTQNKIFQCDKYVKVFHKFSNSNRHTIRHTGKKSFKCKECEKSFCMLSHLAQHKRIHSGEKPYKCKECGKAYNETSNLSTHKRIHTGKKPYKCEECGKAFNRLSHLTTHKIIHTGKKPYKCEECGKAFNQSANLTTHKRIHTGEKPYKCEECGRAFSQSSTLTAHKIIHAGEKPYKCEECGKAFSQSSTLTTHKIIHTGEKFYKCEECGKAFSQLSHLTTHKRIHSGEKPYKCEECGKAFKQSSTLTTHKRIHAGEKFYKCEVCSKAFSRFSHLTTHKRIHTGEKPYKCEECGKAFNLSSQLTTHKIIHTGEKPYKCEECGKAFNQSSTLSKHKVIHTGEKPYKYEECGKAFNQSSHLTTHKMIHTGEKPYKCEECGKAFNNSSILNRHKMIHTGEKLYKPESCNNACDNIAKISKYKRNCAGEK

SEQ ID NO: 16201 - protein, 646 aa, Homo Sapiens
MNECNVHKEGYNELNQYLTTTQSKIFQCDKYVKVFHKLLNSNRHNTKHTGKKPFKCKKCGKSFCMLLHLCQHKRIHIRENSYRCEECGKAFIWFSTLTRHRRVHTGEKSYKYECGKSFNQDSNLTTHKRIHTGQKPYKCEECGTSFYQFSYLTRHKLIHTREKPYKCEQYGKTFNQSSTLTGHKIIHNGEKPYKCEECGKAFSIFSTPTKHKIIHTEEKSHRCEEYCKAYKESSHLTTHKRIHTGEKPYKCEECGKAFSIFSTLTKHKIIHTEEKSHRCEECGKAYKESSHLTTHKRIHTGEKPYKCEECGKTFSVFSILTKHKIIHTEEKPYKCEECGKAFKRSSTLTKHRIIHTEEKPYKCEECGKAFNQSSTLSIHKIIHTGEKPYKCEECGKAFKRSSTLTIHKMIHTGEKPYKCEECGKAFNRSSHLTTHKRIHTGHKPYKCKECGKSFSVFSTLTKHKIIHTDKKPYKCEECGKAFNRSSILSIHKKIHTGEKPYKCEECGKAFKRSSHLAGHKQIHSVQKPYKCEECGKAFSIFSTLTKHKIIHTEEKPYKCEKCGKTFYRFSNLNTHKIIHTGEKPCKCEECGKAFNHSSNLIKHKLIHTGDKPYKCEACGKAFRRSSHLSRHKIIHIGIHTEETVQK

SEQ ID NO: 16202 - protein, 587 aa, Homo Sapiens
MPTALCPRVLAPKESEEPRKMRSPPGENPSPQGELPSPESSRRLFRRFRYQEAAGPREALQRLWDLCGGWLRPERHTKEQILELLVLEQFLAILPREIQSWVRAQEPESGEQAVAAVEALEREPGRPWQWLKHCEDPVVIDDGDSPLDQEQEQLPVEPHSDLAKNQDAQPITLAQCLGLPSRPPSQLSGDPVLQDAFLLQEENVRDTQQVTTLQLPPSRVSPFKDMILCFSEEDWSLLDPAQTGFYGEFIIGEDYGVSMPPNDLAAQPDLSQGEENEPRVPELQDLQGKEVPQVSYLDSPSLQPFQVEERRKREELQVPEFQACPQTVVPQNTYPAGGNPRSLENSLDEEVTIEIVLSSSGDEDSQHGPYCTEELGSPTEKQRSLPASHRSSTEAGGEVQTSKKSYVCPNCGKIFRWRVNFIRHLRSRREQEKPHECSVCGELFSDSEDLDGHLESHEAQKPYRCGACGKSFRLNSHLLSHRRIHLQPDRLQPVEKREQAASEDADKGPKEPLENGKAKLSFQCCECGKAFQRHDHLARHRSHFHLKDKARPFQCRYCVKSFTQNYDLLRHERLHMKRRSKQALNSY

SEQ ID NO: 16203 - protein, 498 aa, Homo Sapiens
MESPRGWTLQVAPEEGQVLCNVKTATRGLSEGAVSGGWGAWENSTEVPREAGDGQRQQATLGAADEQGGPGRELGPADGGRDGAGPRSEPADRALRPSPLPEEPGCRCGECGKAFSQGSYLLQHRRVHTGEKPYTCPECGKAFAWSSNLSQHQRIHSGEKPYACRECGKAFRAHSQLIHHQETHSGLKPFRCPDCGKSFGRSTTLVQHRRTHTGEKPYECPECGKAFSWNSNFLEHRRVHTGARPHACRDCGKAFSQSSNLAEHLKIHAGARPHACPDCGKAFVRVAGLRQHRRTHSSEKPFPCAECGKAFRESSQLLQHQRTHTGERPFECAECGQAFVMGSYLAEHRRVHTGEKPHACAQCGKAFSQRSNLLSHRRTHSGAKPFACADCGKAFRGSSGLAHHRLSHTGERPFACAECGKAFRGSSELRQHQRLHSGERPFVCAHCSKAFVRKSELLSHRRTHTGERPYACGECGKPFSHRCNLNEHQKRHGGRAAP

SEQ ID NO: 16204 - protein, 480 aa, Homo Sapiens
MATVPGLQPLPTLEQDLEQEEILIVKVEEDFCLEEEPSVETEDPSPETFRQLFRLFCYQEVAGPREALSRLWELCCRWLRPELRTKEQILELLVLEQFLTVLPGEIQARVREQQPESGEEAVVLVEGLQRKPRKHRQRGSELLSDDEVPLGIGGQFLKHQAEAQPEDLSLEEEARFSSQQPPAQLSHRPQRGPLLWPERGPPAPRHQEMASASPFLSAWSQVPVNLEDVAVYLSGEEPRCMDPAQRDAPLENEGPGIQLEDGGDGREDAPLRMEWYRVLSARCQGPGHPLPGQRPAPVRGLVRPDQPRGGPPPGRRASHGADKPYTCPECGKGFSKTSHLTKHQRTHTGERPYKCLVCGKGFSDRSNFSTHQRVHTGEKPYPCPECGKRFSQSSSLVIHRRTHSGERPYACTQCGKRFNNSSHFSAHRRTHTGEKPYTCPACGRGFRRGTDLHKHQRTHMGAGSLPTLQPVAPGGPGAKA

SEQ ID NO: 16205 - protein, 271 aa, Homo Sapiens
MNSSQISLRMKHGRVNMQKKPSKCSECGKFFTQRSSLTQHQRIHRGEKPYVCSECGSCFRKQSNLTQHLRIHTGEKPYKCNECEKAFQTKAILVQHLRIHTGEKPYKCNECGKAFCQSPSLIKHQRIHTGEKPYKCTECGKAFSQSICLTRHQRSHSGDKPFKCNECGKAFNQSACLMQHQRIHSGEKPYTCTECGKAFTQNSSLVEHERTHTGEKLYKCSECEKTFRKQAHLSEHYRIHTGEKPYECVGCGKSFRHSSALLRHQRLHAGE

SEQ ID NO: 16206 - protein, 544 aa, Homo Sapiens
MLNMQGAEERDIRRETCPGWVNKNKPALEQDVCKIDSSGIVVKRFQEDEYQDSTFEEKYACEGMKENSPREIAESCLFQEGGFGRITFIHKEAPPEIISQGYNFEKSLLLTSSLVTRLRVSTEESLHQWETSNIQTNDISDQSKCPTLCTQKKSWKCNECGKTFTQSSSLTQHQRTHTGERPYTCEECGKAFSRSSFLVQHQRIHTGVKPYGCEQCGKTFRCRSFLTQHQRIHTGEKPYKCNECGNSFRNHSHLTEHQRIHTGEKPYKCNRCGKAFNQNTHLIHHQRIHTGEKPYICSECGSSFRKHSNLTQHQRIHTGEKPHKCDECGKTFQTKANLSQHQRIHSGEKPYKCKECGKAFCQSPSLIKHQRIHTGEKPYKCKECGKAFTQSTPLTKHQRIHTGERPYKCSECGKAFIQSICLIRHQRSHTGEKPYKCNECGKGFNQNTCLTQHMRIHTGEKPYKCKECGKAFAHSSSLTEHHRTHTGEKLYKCSECEKTFRKYAHLSEHYRIHTGEKPYECIECGKFFRHSSVLFRHQKLHSGD

SEQ ID NO: 16207 - protein, 646 aa, Homo Sapiens
MSTAPSLSALRSSKHSGGGGGGGGGGGADPAWTSALSGNSSGPGPGSSPAGSTKPFVHAVPPSDPLRQANRLPIKVLKMLTARTGHILHPEYLQPLPSTPVSPIELDAKKSPLALLAQTCSQIGKPDPSPSSKLSSVASNGGGAGGAGGGAAGDKDTKSGPLKLSDIGVEDKSSFKPYSKPGSDKKEPGGGGGGGGGGGGGGGGVSSEKSGFRVPSATCQPFTPRTGSPSSSASACSPGGMLSSAGGAPEGKDDKKDTDVGGGGKGTGGASAEGGPTGLAHGRISCGGGINVDVNQHPDGGPGGKALGSDCGGSSGSSSGSGPSAPTSSSVLGSGLVAPVSPYKPGQTVFPLPPAGMTYPGSLAGAYAGYPPQFLPHGVALDPTKPGSLVGAQLAAAAAGSLGCSKPAGSSPLAGASPPSVMTASLCRDPYCLSYHCASHLAGAAAASASCAHDPAAAAAALKSGYPLVYPTHPLHGVHSSLTAAAAAGATPPSLAGHPLYPYGFMLPNDPLPHICNWVSANGPCDKRFATSEELLSHLRTHTAFPGTDKLLSGYPSSSSLASAAAAAMACHMHIPTSGAPGSPGTLALRSPHHALGLSSRYHPYSKSPLPTPGAPVPVPAATGPYYSPYALYGQRLTTASALGYQ

SEQ ID NO: 16208 - protein, 444 aa, Homo Sapiens
MGPLQFRDVAIEFSLEEWHCLDAAQRNLYRDVMLENYRNLIFLGIVVSKPNLITCLEQGKKPLTMKRHEMIAKPPVMYSHFAQDLWSEQSIKDSFQKVILRRYEKCRHDNLQLKKGCESVDECPVHKRGYNGLKQCLATTQRKIFQCDEYVKFLHKFSNSNKHKIRDTGKKSFKCIEYGKTFNQSSTRTTYKKIDAGEKRYKCEECGKAYKQSSHLTTHKKIHTGEKPYKCEECGKAYKQSCNLTTHKIIHTGEKPYRCRECGKAFNHPATLFSHKKIHTGEKPYKCDKCGKAFISSSTLTKHEIIHTGEKPYKCEECGKAFNRSSNLTKHKRIHTGDVPYKCDECGKTFTWYSSLSKHKRAHTGEKPYKCEECGKAFTAFSTLTEHKIIHTGEKPYKCEECGKAFNWSSALNKHKKIHIRQKPCIVKNVENLLNVPQPLISIR

SEQ ID NO: 16209 - protein, 953 aa, Homo Sapiens
MEESSSVAMLVPDIGEQEAILTAESIISPSLEIDEQRKTKPDPLIHVIQKLSKIVENEKSQKCLLIGKKRPRSSAATHSLETQELCEIPAKVIQSPAADTRRAEMSQTNFTPDTLAQNEGKAMSYQCSLCKFLSSSFSVLKDHIKQHGQQNEVILMCSECHITSRSQEELEAHVVNDHDNDANIHTQSKAQQCVSPSSSLCRKTTERNETIPDIPVSVDNLQTHTVQTASVAEMGRRKWYAYEQYGMYRCLFCSYTCGQQRMLKTHAWKHAGEVDCSYPIFENENEPLGLLDSSAAAAPGGVDAVVIAIGESELSIHNGPSVQVQICSSEQLSSSSPLEQSAERGVHLSQSVTLDPNEEEMLEVISDAEENLIPDSLLTSAQKIISSSPNKKGHVNVIVERLPSAEETLSQKRFLMNTEMEEGKDLSLTEAQIGREGMDDVYRADKCTVDIGGLIIGWSSSEKKDELMNKGLATDENAPPGRRRTNSESLRLHSLAAEALVTMPIRAAELTRANLGHYGDINLLDPDTSQRQVDSTLAAYSKMMSPLKNSSDGLTSLNQSNSTLVALPEGRQELSDGQVKTGISMSLLTVIEKLRERTDQNASDDDILKELQDNAQCQPNSDTSLSGNNVVEYIPNAERPYRCRLCHYTSGNKGYIKQHLRVHRQRQPYQCPICEHIADNSKDLESHMIHHCKTRIYQCKQCEESFHYKSQLRNHEREQHSLPDTLSIATSNEPRISSDTADGKCVQEGNKSSVQKQYRCDVCDYTSTTYVGVRNHRRIHNSDKPYRCSLCGYVCSHPPSLKSHMWKHASDQNYNYEQVNKAINDAISQSGRVLGKSPGKTQLKSSEESADPVTGSSENAVSSSELMSQTPSEVLGTNENEKLSPTSNTSYSLEKISSLAPPSMEYCVLLFCCCICGFESTSKENLLDHMKEHEGEIVNIILNKDHNTALNTN

SEQ ID NO: 16210 - protein, 683 aa, Homo Sapiens
MSPHPEAITDCVTLNTVGQLAEGGYPLRFSTLFQEQQKMNISQASVSFKDVTIEFTQEEWQQMAPVQKNLYRDVMLENYSNLVSVGYCCFKPEVIFKLEQGEEPWFSEEEFSNQSHPKDYRGDDLIKQNKKIKDKHLEQAICINNKTLTTEEEKVLGKPFTLHVAAVASTKMSCKCNSWEVNLQSISEFIINNRNYSTKKIGCGNVCENSPFKINFEKTQTGEKFYEHNKNMKALNYNENLPKHPKFQTLEQAFECNKIGKAFNDKANCVKHNSSHTGETSSKDDEFRKNCDKKTLFDHRRTGTGKKHLHLNQCGKSFEKSTVEEYNKLNMGIKHYELNPSGNNFNRKAHLTDPQTAVIEENPLVSNDRTQTWVKSSEYHENKKSYQTSVHRVRRRSHSMMKPYKCNECGKSFCQKGHLIQHQRTHTGEKPFECSECGKTFSQKSHLSTHQRIHTAEKPYKCNECGKTFVQKSTLRGHQRIHTGEKPYECSECGKTFVQKSTLRDHHRIHTGEKSFQCNQCGKTFGQKSNLRIHQRTHTGEKTYQCNECEKSFWRKDHLIQHQKTHTGEKPFKCNECGKTFARTSTLRVHQRIHTGEKPFKCNECGKKFVRKAILSDHQRIHTGEKPFQCNKCGKTFGQKSNLRIHQRTHSGEKSYECNEYGKLCKKSTLSLYQKIQGEGNPY

SEQ ID NO: 16211 - protein, 262 aa, Homo Sapiens; identical to SEQ ID NO: 14441

SEQ ID NO: 16212 - protein, 567 aa, Homo Sapiens
MSSRLGAVPATSGPTTFKQQRSTRIVGAKNSRTQCSIKDNSFQYTIPHDDSLSGSSSASSCEPVSDFPASFRKSTYWMKMRRIKPAATSHVEGSGGVSAKGKRKPRQEEDEDYREFPQKKHKLYGRKQRPKTQPNPKSQARRIRKEPPVYAAGSLEEQWYLEIVDKGSVSCPTCQAVGRKTIEGLKKHMENCKQEMFTCHHCGKQLRSLAGMKYHVMANHNSLPILKAGDEIDEPSERERLRTVLKRLGKLRCMRESCSSSFTSIMGYLYHVRKCGKGAAELEKMTLKCHHCGKPYRSKAGLAYHLRSEHGPISFFPESGQPECLKEMNLESKSGGRVQRRSAKIAVYHLQELASAELAKEWPKRKVLQDLVPDDRKLKYTRPGLPTFSQEVLHKWKTDIKKYHRIQCPNQGCEAVYSSVSGLKAHLGSCTLGNFVAGKYKCLLCQKEFVSESGVKYHINSVHAEDWFVVNPTTTKSFEKLMKIKQRQQEEEKRRQQHRSRRSLRRRQQPGIELPETELSLRVGKDQRRNNEELVVSASCKEPEQEPVPAQFQKVKPPKTNHKRGRK

SEQ ID NO: 16213 - protein, 892 aa, Homo Sapiens
MTDPFCVGGRRLPGSSKSGPGKDGSRKEVRLPMLHDPPKMGMPVVRGGQTVPGQAPLCFDPGSPASDKTEGKKKGRPKAENQALRDIPLSLMNDWKDEFKAHSRVKCPNSGCWLEFPSIYGLKYHYQRCQGGAISDRLAFPCPFCEAAFTSKTQLEKHRIWNHMDRPLPASKPGPISRPVTISRPVGVSKPIGVSKPVTIGKPVGVSKPIGISKPVSVGRPMPVTKAIPVTRPVPVTKPVTVSRPMPVTKAMPVTKPITVTKSVPVTKPVPVTKPITVTKLVTVTKPVPVTKPVTVSRPIVVSKPVTVSRPIAISRHTPPCKMVLLTRSENKAPRATGRNSGKKRAADSLDTCPIPPKQARPENGEYGPSSMGQSSAFQLSADTSSGSLSPGSRPSGGMEALKAAGPASPPEEDPERTKHRRKQKTPKKFTGEQPSISGTFGLKGLVKAEDKARVHRSKKQEGPGPEDARKKVPAAPITVSKEAPAPVAHPAPGGPEEQWQRAIHERGEAVCPTCNVVTRKTLVGLKKHMEVCQKLQDALKCQHCRKQFKSKAGLNYHTMAEHSAKPSDAEASEGGEQEERERLRKVLKQMGRLRCPQEGCGAAFSSLMGYQYHQRRCGKPPCEVDSPSFPCTHCGKTYRSKAGHDYHVRSEHTAPPPEEPTDKSPEAEDPLGVERTPSGRVRRTSAQVAVFHLQEIAEDELARDWTKRRMKDDLVPETARLNYTRPGLPTLNPQLLEAWKNEVKEKGHVNCPNDCCEAIYSSVSGLKAHLASCSKGAHLAGKYRCLLCPKEFSSESGVKYHILKTHAENWFRTSADPPPKHRSQDSLVPKKEKKKNLAGGKKRGRKPKERTPEEPVAKLPPRRDDWPPGCRDKGARGSTGRKVGVSKAPEK

SEQ ID NO: 16214 - protein, 541 aa, Homo Sapiens
MPRRKQSHPQPVKCEGVKVDTEDSLDEGPGALVLESDLLLGQDLEFEEEEEEEEGDGNSDQLMGFERDSEGDSLGARPGLPYGLSDDESGGGRALSAESEVEEPARGPGEARGERPGPACQLCGGPTGEGPCCGAGGPGGGPLLPPRLLYSCRLCTFVSHYSSHLKRHMQTHSGEKPFRCGRCPYASAQLVNLTRHTRTHTGEKPYRCPHCPFACSSLGNLRRHQRTHAGPPTPPCPTCGFRCCTPRPARPPSPTEQEGAVPRRPEDALLLPDLSLHVPPGGASFLPDCGQLRGEGEGLCGTGSEPLPELLFPWTCRGCGQELEEGEGSRLGAAMCGRCMRGEAGGGASGGPQGPSDKGFACSLCPFATHYPNHLARHMKTHSGEKPFRCARCPYASAHLDNLKRHQRVHTGEKPYKCPLCPYACGNLANLKRHGRIHSGDKPFRCSLCNYSCNQSMNLKRHMLRHTGEKPFRCATCAYTTGHWDNYKRHQKVHGHGGAGGPGLSASEGWAPPHSPPSVLSSRGPPALGTAGSRAVHTDSS

SEQ ID NO: 16215 - protein, 400 aa, Homo Sapiens
MTFEDVAVEFSQWEWGQLNPAQKDLYREVMLENFRNLAILGLLVSKPYVICQLEEGGEPFMVEREISTGAHSDWKRRSKSKESMPSWGISKEELFQVVSVEKHIQDVLQFSKLKAACGCDGQLEMQQIKQERHLKQMSTIHKSATTLSRDYKWNGFGRSLGLRSVLVNQHSILMGEGSYKCDTEFRQTLGGNNSQRTHPEKKSCKCNECGKSFHFQSELRRHQRCHTGEKPYECSDCGRAFGHISSLIKHQRTHTGEKPYECSECGRAFSQSSSLVLHYRFHTGEKPYKCNECGRAFGHTSSLIKHQRTHTGEKPYECRECGRTFSQSSSLIVHYRFHTGEKPYKCNKCGRAFSQSSSLTQHYRFHTGEKPYKCNECGRAFAHTASLIKHQRSHAGKKTL

SEQ ID NO: 16216 - protein, 1163 aa, Homo Sapiens
MDRNREAEMELRRGPSPTRAGRGHEVDGDKATCHTCCICGKSFPFQSSLSQHMRKHTGEKPYKCPYCDHRASQKGNLKIHIRSHRTGTLIQGHEPEAGEAPLGEMRASEGLDACASPTKSASACNRLLNGASQADGARVLNGASQADSGRVLLRSSKKGAEGSACAPGEAKAAVQCSFCKSQFERKKDLELHVHQAHKPFKCRLCSYATLREESLLSHIERDHITAQGPGSGEACVENGKPELSPGEFPCEVCGQAFSQTWFLKAHMKKHRGSFDHGCHICGRRFKEPWFLKNHMKAHGPKTGSKNRPKSELDPIATINNVVQEEVIVAGLSLYEVCAKCGNLFTNLDSLNAHNAIHRRVEASRTRAPAEEGAEGPSDTKQFFLQCLNLRPSAAGDSCPGTQAGRRVAELDPVNSYQAWQLATRGKVAEPAEYLKYGAWDEALAGDVAFDKDRREYVLVSQEKRKREQDAPAAQGPPRKRASGPGDPAPAGHLDPRSAARPNRRAAATTGQGKSSECFECGKIFRTYHQMVLHSRVHRRARRERDSDGDRAARARCGSLSEGDSASQPSSPGSACAAADSPGSGLADEAAEDSGEEGAPEPAPGGQPRRCCFSEEVTSTELSSGDQSHKMGDNASERDTGESKAGIAASVSILENSSRETSRRQEQHRFSMDLKMPAFHPKQEVPVPGDGVEFPSSTGAEGQTGHPAEKLSDLHNKEHSGGGKRALAPDLMPLDLSARSTRDDPSNKETASSLQAALVVHPCPYCSHKTYYPEVLWMHKRIWHRVSCNSVAPPWIQPNGYKSIRSNLVFLSRSGRTGPPPALGGKECQPLLLARFTRTQVPGGMPGSKSGSSPLGVVTKAASMPKNKESHSGGPCALWAPGPDGYRQTKPCHGQEPHGAATQGPLAKPRQEASSKPVPAPGGGGFSRSATPTPTVIARAGAQPSANSKPVEKFGVPPAGAGFAPTNKHSAPDSLKAKFSAQPQGPPPAKGEGGAPPLPPREPPSKAAQELRTLATCAAGSRGDAALQAQPGVAGAPPVLHSIKQEPVAEGHEKRLDILNIFKTYIPKDFATLYQGWGVSGPGLEHRGTLRTQARPGEFVCIECGKSFHQPGHLRAHMRAHSVVFESDGPRGSEVHTTSADAPKQGRDHSNTGTVQTVPLRKGT

SEQ ID NO: 16217 - protein, 492 aa, Homo Sapiens
MAMALPMPGPQEAVVFEDVAVYFTRIEWSCLAPDQQALYRDVMLENYGNLASLGFLVAKPALISLLEQGEEPGALILQVAEQSVAKASLCTDSRMEAGIMESPLQRKLSRQAGLPGTVWGCLPWGHPVGGHPAPPHPHGGPEDGSDKPTHPRAREHSASPRVLQEDLGRPVGSSAPRYRCVCGKAFRYNSLLLRHQIIHTGAKPFQCTECGKAFKQSSILLRHQLIHTEEKPFQCGECGKAFRQSTQLAAHHRVHTRERPYACGECGKAFSRSSRLLQHQKFHTGEKPFACTECGKAFCRRFTLNEHGRIHSGERPYRCLRCGQRFIRGSSLLKHHRLHAQEGAQDGGVGQGALLGAAQRPQAGDPPHECPVCGRPFRHNSLLLLHLRLHTGEKPFECAECGKAFGRKSNLTLHQKIHTKEKPFACTECGKAFRRSYTLNEHYRLHSGERPYRCRACGRACSRLSTLIQHQKVHGREPGEDTEGRRAPCWAS

SEQ ID NO: 16218 - protein, 1483 aa, Homo Sapiens
MPSEQKQLFCDEKQTTLKKDYDVKNEIVDRSAPKPKISGSIHYALKNVKIDLPKINIPNEVLLKHEVDKYRKLFQSKQQTARKSISIKTVSCVEECTLLHKSERAEEEGVKMSAKILNFSCLKCRDNTRYSPNDLQKHFQMWHHGELPSYPCEMCNFSANDFQVFKQHRRTHRSTLVKCDICNNESVYTLLNLTKHFTSTHCVNGNFQCEKCKFSTQDVGTFVQHIHRHNEIHYKCGKCHHVCFTKGELQKHLHIHSGTFPFTCQYCSYGATRREHLVRHVITLHKEHLYAKEKLEKDKYEKRMAKTSAGLKLILKRYKIGASRKTFWKRKKINSGSDRSIEKNTQVLKKMNKTQTKSEDQSHVVQEHLSEEKDERLHCENNDKAPESESEKPTPLSTGQGNRAEEGPNASSGFMKTAVLGPTLKNVMMKNNKLAVSPNYNATFMGFKMMDGKQHIVLKLVPIKQNVCSPGSQSGAAKDGTANLQPQTLDTNGFLTGVTTELNDTVYMKAATPFSCSSSILSGKASSEKEMTLISQRNNMLQTMDYEKSVSSLSATSELVTASVNLTTKFETRDNVDFWGNHLTQSHPEVLGTTIKSPDKVNCVAKPNAYNSGDMHNYCINYGNCELPVESSNQGSLPFHNYSKVNNSNKRRRFSGTAVYENPQRESSSSKTVVQQPISESFLSLVRQESSKPDSLLASISLLNDKDGTLKAKSEIEEQYVLEKGQNIDGQNLYSNENQNLECATEKSKWEDFSNVDSPMMPRITSVFSLQSQQASEFLPPEVNQLLQDVLKIKPDVKQDSSNTPNKGLPLHCDQSFQKHEREGKIVESSKDFKVQGIFPVPPGSVGINVPTNDLNLKFGKEKQVSSIPQDVRDSEKMPRISGFGTLLKTQSDAIITQQLVKDKLRATTQNLGSFYMQSPLLNSEQKKTIIVQTSKGFLIPLNITNKPGLPVIPGNALPLVNSQGIPASLFVNKKPGMVLTLNNGKLEGVSAVKTEGAPARGTVTKEPCKTPILKVEPNNNCLTPGLCSSIGSCLSMKSSSENTLPLKGPYILKPTSSVKAVLIPNMLSEQQSTKLNISDSVKQQNEIFPKPPLYTFLPDGKQAVFLKCVMPNKTELLKPKLVQNSTYQNIQPKKPEGTPQRILLKIFNPVLNVTAANNLSVSNSASSLQKDNVPSNQIIGGEQKEPESRDALPFLLDDLMPANEIVITSTATCPESSEEPICVSDCSESRVLRCKTNCRIERNFNRKKTSKKIFSKTKTHGSKDSETAFVSRNRNCKRKCRDSYQEPPRRKATLHRKCKEKAKPEDVRETFGFSRPRLSKDSIRTLRLFPFSSKQLVKCPRRNQPVVVLNHPDADAPEVVSVMKTIAKFNGHVLKVSLSKRTINALLKPVCYNPPKTTYDDFSKRHKTFKPVSSVKERFVLKLTLKKTSKNNYQIVKTTSENILKAKFNCWFCGRVFDNQDTWAGHGQRHLMEATRDWNMLE

SEQ ID NO: 16219 - protein, 1074 aa, Homo Sapiens
MKDIGQQLYTTHLNGGHNSLTMSPKQPDANGAPRPNRQEAQTLLYQGSEAEAAMMTIATCAKCKSVHKISLQDLQKGTGKDGMYVCFQCSLGAAPPNFHFVSNNSSATHVGNKTENFSSSVNSKFKVRNFKPGKYYCDKCRFSTKDPLQYKKHTLQHEEIKFICSHCSYISYTKGEFQRHLVKHTGIFPYQCEYCDYGAIRNDYIVKHTKRVHERAGAKRPVKAVAKLEPKRTGTSKQNPELLKASNPRTTFQNKWSDQLSGFSLHANKDKMHNIMLLPEPKEYQKDVVCIPNKMTLSEPNEVNLFENKNVEVEVLSPAKEPVQPGMPLTVVAPAELVVPANCLAQLIDVKVVNGTQQLVLKLFPLEENNCLEAGRDNGGNSERMVKEKGSNEQEKVLSAEKTKSLTVDGNVGKLVGIDSFQPSVQKQLKNVKWVRSYDFIMPNSSVHNNGKSFINSETIEDFQKKNNLYPHRTAFPSVALKGHSLASVFKNSVLRSLGAASNPFPYKAAVCFAESGRNLHSSSQQLLPFAASPATCSFSGEKGLLPVSENDLESTSKVNIPVKVVSSNRKQEDNQTEEHKAVSTVGQISSQHKSEYLHINITGEDRSQQPGDKPLELKNSERTNNTNDGPVISSVFSLSSGSENVPEGIKWNSSTSKIKSIELLRRKIAQLIESCGKPSSLASNSAHRRSVGQASKGTSKATSEGIQEINVSLTGLGHSTGTLQKPPNDGGITGNRQLTHQQIYPHFADGSNRKTKSRVARKAHVATPVLIPKGAVLRVLNSSENAHIIEATCEAPVSIPCSERQLIKPVPFCPVRQADSDLQPLRSERGPIDMSPNIETPLRPKLRKESAVCSTIHRKTGLLYGQQGSSELNKQGRLLSRSLSISRNKTKQVHLSRKKNKIQAEPSRCLKDPSIFQVARQLRLIAAKPDQLIKCPRRNQPVIVLNHPDVDSPEVTNVMKVINKYKGNVLKVVLSERTRCQLGIRRHHVRLTYQNAEEASQIKRQMMLKMKLKKVHKNNYQVVDSLPDDSSQCVFKCWFCGRLYEDQEEWMSHGQRHLIEATRDWDVLSSKGK

SEQ ID NO: 16220 - protein, 540 aa, Homo Sapiens
MELLTFRDVAIEFSPEEWKCLDPAQQNLYRDVMLENYRNLVSLAVYSYYNQGILPEQGIQDSFKKATLGRYGSCGLENICLWKNWESIGEGEGQKECYNLCSQYLTTSHNKHLTVKGDKEYRIFQKKPQFLSAAPTEPCIPMNKYQHKFLKSVFCNKNQINFNHDSNISKHHSTHFLENYYNCNECEKVFYQSSKLIFPENIHIQKKPYNSNECGETSDPFSKLTQHQRIYIGESSQRCNKKCIIVFSQSHLKGHKIINTGEKSVKYKERGKAFTRGLHLGHQKIHTGEKPYKCKKCDKAFNKSSHLAQHQRIHTGEKPFKCKECGKAFNRGSYLTQHQRIHTGERAFKCEECGKAFNRGSYLTQHQRIHTGEKPFRCKECGKAFNRSSYVTQHQRMHTGEKPFKCKECGKAFNRASHLTQHQRIHTGEKHFKCKECGKAFNRGSHLTRHQRIHTGEKSFKCEECGKAFIWGSHLTQHQRVHTGEKFFKCKECGKAFTRSSHLTQHQRIHTGEKPFKCKECGKAFNRRSTLTQHQIIHTR

SEQ ID NO: 16221 - protein, 1311 aa, Homo Sapiens
MSRRKQAKPRSLKDPNCKLEDKTEDGEALDCKKRPEDGEELEDEAVHSCDSCLQVFESLSDITEHKINQCQLTDGVDVEDDPTCSWPASSPSSKDQTSPSHGEGCDFGEEEGGPGLPYPCQFCDKSFSRLSYLKHHEQSHSDKLPFKCTYCSRLFKHKRSRDRHIKLHTGDKKYHCSECDAAFSRSDHLKIHLKTHTSNKPYKCAICRRGFLSSSSLHGHMQVHERNKDGSQSGSRMEDWKMKDTQKCSQCEEGFDFPEDLQKHIAECHPECSPNEDRAALQCVYCHELFVEETSLMNHMEQVHSGEKKNSCSICSESFHTVEELYSHMDSHQQPESCNHSNSPSLVTVGYTSVSSTTPDSNLSVDSSTMVEAAPPIPKSRGRKRAAQQTPDMTGPSSKQAKVTYSCIYCNKQLFSSLAVLQIHLKTMHLDKPEQAHICQYCLEVLPSLYNLNEHLKQVHEAQDPGLIVSAMPAIVYQCNFCSEVVNDLNTLQEHIRCSHGFANPAAKDSNAFFCPHCYMGFLTDSSLEEHIRQVHCDLSGSRFGSPVLGTPKEPVVEVYSCSYCTNSPIFNSVLKLNKHIKENHKNIPLALNYIHNGKKSRALSPLSPVAIEQTSLKMMQAVGGAPARPTGEYICNQCGAKYTSLDSFQTHLKTHLDTVLPKLTCPQCNKEFPNQESLLKHVTIHFMITSTYYICESCDKQFTSVDDLQKHLLDMHTFVFFRCTLCQEVFDSKVSIQLHLAVKHSNEKKVYRCTSCNWDFRNETDLQLHVKHNHLENQGKVHKCIFCGESFGTEVELQCHITTHSKKYNCKFCSKAFHAIILLEKHLREKHCVFETKTPNCGTNGASEQVQKEEVELQTLLTNSQESHNSHDGSEEDVDTSEPMYGCDICGAAYTMETLLQNHQLRDHNIRPGESAIVKKKAELIKGNYKCNVCSRTFFSENGLREHMQTHLGPVKHYMCPICGERFPSLLTLTEHKVTHSKSLDTGNCRICKMPLQSEEEFLEHCQMHPDLRNSLTGFRCVVCMQTVTSTLELKIHGTFHMQKTGNGSAVQTTGRGQHVQKLYKCASCLKEFRSKQDLVKLDINGLPYGLCAGCVNLSKSASPGINVPPGTNRPGLGQNENLSAIEGKGKVGGLKTRCSSCNVKFESESELQNHIQTIHRELVPDSNSTQLKTPQVSPMPRISPSQSDEKKTYQCIKCQMVFYNEWDIQVHVANHMIDEGLNHECKLCSQTFDSPAKLQCHLIEHSFEGMGGTFKCPVCFTVFVQANKLQQHIFSAHGQEDKIYDCTQCPQKFFFQTELQNHTMTQHSS

SEQ ID NO: 16222 - protein, 264 aa, Homo Sapiens
MDTPSPDPLPSPLPGEEEKPLALSPPVPRGRRGRRPGGATSSNRTLKASLPRKRGRPPKSGQEPPLVQVQGVTAPVGSSGGSDLLLIDDQGVPYTVSEGSAAGPEGSGPRKAPHFCPVCLRAFPYLSDLERHSISHSELKPHQCKVCGKTFKRSSHLRRHCNIHAGLRPFRCPLCPRRFREAGELAHHHRVHSGERPYQCPICRLRFTEANTLRRHAKRKHPEAMGVPLCAPDPGSEPPWDEEGIPATAGAEEEEETEGKGEPA

SEQ ID NO: 16223 - protein, 670 aa, Homo Sapiens
MAEVVAEVAEMPTQMSPGAVEMSTPMSAEMMEMSTEVTEMTPGEALASSLFFQHHQFMCSECGSLYNTLEEVLSHQEQHMLAVSEEEALTTQNVGLEPELVPGAEGPFQCGECSQLILSPGELLAHQDAHLRESANQIQYQCWDCQELFPSPELWVAHRKAQHLSATVAEPPVPPPLPPPTPLPPPSPPSEVKMEPYECPECSTLCATPEEFLEHQGTHFDSLEKEERNGLEEEEEDDEEDEEDDEEMEDEEAMAEVGDDAVGGDESTAGWAQGCGDCPQHQPSAGARRQHRRTAHSPASATHPFHCSQCQRSFSSANRLQAHGRAHVGGTHECTTCSKVFKKAASLEQHLRLHRGEARYLCVDCGRGFGTELTLVAHRRAHTANPLHRCRCGKTFSNMTKFLYHRRTHAGKSGAPPTGATAPPAPAEPTPPPPPPAPPAQLPCPQCSKSFASASRLSRHRRAVHGPPERRHRCGVCGKGFKKLIHVRNHLRTHTGERPFQCHSCGKTFASLANLSRHQLTHTGARPYQCLDCGKRFTQSSNLQQHRRLHLRPVAFARAPRLPITGLYNKSPYYCGTCGRWFRAMAGLRLHQRVHARARTLTLQPPRSPSPAPPPPPEPQQTIMCTELGETIAIIETSQPLALEDTLQLCQAALGASEAGGLLQLDTAFV

SEQ ID NO: 16224 - protein, 609 aa, Homo Sapiens
MAVGLCKAMSQGLVTFRDVALDFSQEEWEWLKPSQKDLYRDVMLENYRNLVWLGLSISKPNMISLLEQGKEPWMVERKMSQGHCADWESWCEIEELSPKWFIDEDEISQEMVMERLASHGLECSSFREAWKYKGEFELHQGNAERHFMQVTAVKEISTGKRDNEFSNSGRSIPLKSVFLTQQKVPTIQQVHKFDIYDKLFPQNSVIIEYKRLHAEKESLIGNECEEFNQSTYLSKDIGIPPGEKPYESHDFSKLLSFHSLFTQHQTTHFGKLPHGYDECGDAFSCYSFFTQPQRIHSGEKPYACNDCGKAFSHDFFLSEHQRTHIGEKPYECKECNKAFRQSAHLAQHQRIHTGEKPFACNECGKAFSRYAFLVEHQRIHTGEKPYECKECNKAFRQSAHLNQHQRIHTGEKPYECNQCGKAFSRRIALTLHQRIHTGEKPFKCSECGKTFGYRSHLNQHQRIHTGEKPYECIKCGKFFRTDSQLNRHHRIHTGERPFECSKCGKAFSDALVLIHHKRSHAGEKPYECNKCGKAFSCGSYLNQHQRIHTGEKPYECSECGKAFHQILSLRLHQRIHAGEKPYKCNECGNNFSCVSALRRHQRIHNRETL

SEQ ID NO: 16225 - protein, 628 aa, Homo Sapiens
MALTQGPLKFMDVAIEFSQEEWKCLDPAQRTLYRDVMLENYRNLVSLGICLPDLSVTSMLEQKRDPWTLQSEEKIANDPDGRECIKGVNTERSSKLGSNAGNKPCKNQLGFTFQLHLSDLQLFQAERKISGCKHFEKPVSDNSSVSPLEKISSSVKSHLLNKYRNNFDHAPLLPQEQKAHIREKAYKCNEHGQVFRASASLTNQVIHNADNPYKCSECGKVFSCSSKLVIHRRMHTGEKPYKCHECGKLFSSNSNLSQHQRIHTGEKPYKCHECDKVFRSSSKLAQHQRIHTGEKPYKCHECDKVFNQIAHLVRHQKIHTGEKPYSCNKCGKVFSRHSYLAEHQTVHTGEKPYKCEECGKAFSVRSSLITHQLIHTGRKPYKCKECDKVFGRKCFLTSHQRIHTRERPYGCSQCGKIFSQKSDLIRHRKTHTDEKPYKCNKCGTAFREFSDLTAHFLIHSGEKPYECKECGKVFRYKSSLTSHHRIHTGEKPYKCNRCGKVFSRSSNLVCHQKIHTGEKPYKCNQCGKVFNQASYLTRHQIIHTGERPYRCSKCGKAFRGCSGLTAHLAIHTEKKSHECKECGKIFTQKSSLTNHHRIHIGEKPYKCTLCSKVFSHNSDLAQHQRVHS

SEQ ID NO: 16226 - protein, 563 aa, Homo Sapiens
MANSSFIGDHVHGAPHAVMPEVEFPDQFFTVLTMDHELVTLRDVVINFSQEEWEYLDSAQRNLYWDVMMENYSNLLSLDLESRNETKHLSVGKDIIQNTGSQWEVMESSKLCGLEGSIFRNDWQSKSKIDLQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYKCKEYRRTFERVGKVTPLQRVHDGEKHFECSFCGKSFRVHAQLTRHQKIHTDEKTYKCMECGKDFRFHSQLTEHQRIHTGEKPYKCMHCEKVFRISSQLIEHQRIHTGEKPYACKECGKAFGVCRELARHQRIHTGKKPYECKACGKVFRNSSSLTRHQRIHTGEKPYKCKECEKAFGVGSELTRHERIHSGQKPYECKECGKFFRLTSALIQHQRIHSGEKPYECKVCGKAFRHSSALTEHQRIHTGEKPYECKACGKAFRHSSSFTKHQRIHTDDKPYECKECGNSFSVVGHLTCQPKIYTGEKSFD

SEQ ID NO: 16227 - protein, 599 aa, Homo Sapiens
MAAALRAPTQQVFVAFEDVAIYFSQEEWELLDEMQRLLYRDVMLENFAVMASLGCWCGAVDEGTPSAESVSVEELSQGRTPKADTSTDKSHPCEICTPVLRDILQMIELHASPCGQKLYLGGASRDFWMSSNLHQLQKLDNGEKLFKVDGDQASFMMNCRFHVSGKPFTFGEVGRDFSATSGLLQHQVTPTIERPHSRIRHLRVPTGRKPLKYTESRKSFREKSVFIQHQRADSGERPYKCSECGKSFSQSSGFLRHRKAHGRTRTHECSECGKSFSRKTHLTQHQRVHTGERPYDCSECGKSFRQVSVLIQHQRVHTGERPYECSECGKSFSHSTNLYRHRSAHTSTRPYECSECGKSFSHSTNLFRHWRVHTGVRPYECSECGKAFSCNIYLIHHQRFHTGERPYVCSECGKSFGQKSVLIQHQRVHTGERPYECSECGKVFSQSSGLFRHRRAHTKTKPYECSECEKSFSCKTDLIRHQTVHTGERPYECSVCGKSFIRKTHLIRHQTVHTNERPYECDECGKSYSQSSALLQHRRVHTGERPYECRECGKSFTRKNHLIQHKTVHTGERPYECSECGKSFSQSSGLLRHRRVHVQ

SEQ ID NO: 16228 - protein, 1301 aa, Homo Sapiens
MTMGDMKTPDFDDLLAAFDIPDMVDPKAAIESGHDDHESHMKQNAHGEDDSHAPSSSDVGVSVIVKNVRNIDSSEGGEKDGHNPTGNGLHNGFLTASSLDSYSKDGAKSLKGDVPASEVTLKDSTFSQFSPISSAEEFDDDEKIEVDDPPDKEDMRSSFRSNVLTGSAPQQDYDKLKALGGENSSKTGLSTSGNVEKNKAVKRETEASSINLSVYEPFKVRKAEDKLKESSDKVLENRVLDGKLSSEKNDTSLPSVAPSKTKSSSKLSSCIAAIAALSAKKAASDSCKEPVANSRESSPLPKEVNDSPRAADKSPESQNLIDGTKKPSLKQPDSPRSISSENSSKGSPSSPAGSTPAIPKVRIKTIKTSSGEIKRTVTRVLPEVDLDSGKKPSEQTASVMASVTSLLSSPASAAVLSSPPRAPLQSAVVTNAVSPAELTPKQVTIKPVATAFLPVSAVKTAGSQVINLKLANNTTVKATVISAASVQSASSAIIKAANAIQQQTVVVPASSLANAKLVPKTVHLANLNLLPQGAQATSELRQVLTKPQQQIKQAIINAAASQPPKKVSRVQVVSSLQSSVVEAFNKVLSSVNPVPVYIPNLSPPANAGITLPTRGYKCLECGDSFALEKSLTQHYDRRSVRIEVTCNHCTKNLVFYNKCSLLSHARGHKEKGVVMQCSHLILKPVPADQMIVSPSSNTSTSTSTLQSPVGAGTHTVTKIQSGITGTVISAPSSTPITPAMPLDEDPSKLCRHSLKCLECNEVFQDETSLATHFQQAADTSGQKTCTICQMLLPNQCSYASHQRIHQHKSPYTCPECGAICRSVHFQTHVTKNCLHYTRRVGFRCVHCNVVYSDVAALKSHIQGSHCEVFYKCPICPMAFKSAPSTHSHAYTQHPGIKIGEPKIIYKCSMCDTVFTLQTLLYRHFDQHIENQKVSVFKCPDCSLLYAQKQLMMDHIKSMHGTLKSIEGPPNLGINLPLSIKPATQNSANQNKEDTKSMNGKEKLEKKSPSPVKKSMETKKVASPGWTCWECDCLFMQRDVYISHVRKEHGKQMKKHPCRQCDKSFSSSHSLCRHNRIKHKGIRKVYACSHCPDSRRTFTKRLMLEKHVQLMHGIKDPDLKEMTDATNEEETEIKEDTKVPSPKRKLEEPVLEFRPPRGAITQPLKKLKINVFKVHKCAVCGFTTENLLQFHEHIPQHKSDGSSYQCRECGLCYTSHVSLSRHLFIVHKLKEPQPVSKQNGAGEDNQQENKPSHEDESPDGAVSDRKCKVCAKTFETEAALNTHMRTHGMAFIKSKRMSSAEK

SEQ ID NO: 16229 - protein, 674 aa, Homo Sapiens
MALTQGQLSFSDVAIEFSQEEWKCLDPGQKALYRDVMLENYRNLVSLGEDNVRPEACICSGICLPDLSVTSMLEQKRDPWTLQSEVKIINNPDGRECIKGVNTEKSSKLGSSAGNKSLKNQHGLTLQLHLTEWQPFQAVRNIYGCKHVEKSISDNSSVSPVQISFFSVKTHIFNNYRNDFLFSTLLPQEQKVHIREKPYGCNEHGKVFRVSSSLTNRQVIHIADKTYKCSDCGEIFSSNSNFAQHQRIHTGEKPYKYNECGKVFNQNSHLAQHQKIHTGQKPYNNKECGKVFSHHAYLAQHRKIHTGEKPYKCSECGKAFSVCSSLTAHLVIHTGEKPYDCKECGKVFRHKSSLTTHQTVHTGERPYKCNECGKGFSRIAFLARHRKVHTGEKPYKCNECGKVFIGNSRLARHRKIHTGGRRYKCNECGKAFRTCSDLTAHLLIHTGEKPYECIDCGKVFRHKSSLTYHCRIHTGEKPYKCNECGKVFSQNSNLQRHRKIHTGEKLYKCNECGKVFRQNSHLAQHRDIHTGEKPYSCNECGKVFRRNSHLVRHRNVHTGEKPYSCNECGKVFSRNSHLARHRNIHTGEKPHSCNECGKVFSRNSHLARHRKIHTGEKLYKCNECSKVFSRNSRLAQHRNIHTGVKPYSCNECGKVFSKNSILVQHCSIHTREKP

SEQ ID NO: 16230 - protein, 1300 aa, Homo Sapiens
MEEASLCLGVSSAEPEAEPHLSGPVLNGQYAMSQKLHQITSQLSHAFPELHPRPNPEEKPPASLEEKAHVPMSGQPMGSQMALLANQLGREVDTSLNGRVDLQQFLNGQNLGIMSQMSDIEDDARKNRKYPCPLCGKRFRFNSILSLHMRTHTGEKPFKCPYCDHRAAQKGNLKIHLRTHKLGNLGKGRGRVREENRLLHELEERAILRDKQLKGSLLQPRPDLKPPPHAQQAPLAACTLALQANHSVPDVAHPVPSPKPASVQEDAVAPAAGFRCTFCKGKFKKREELDRHIRILHKPYKCTLCDFAASQEEELISHVEKAHITAESAQGQGPNGGGEQSANEFRCEVCGQVFSQAWFLKGHMRKHKDSFEHCCQICGRRFKEPWFLKNHMKVHLNKLSVKNKSPSDPEVPVPMGGMSQEAHANLYSRYLSCLQSGFMTPDKAGLSEPSQLYGKGELPMKEKEALGKLLSPISSMAHGVPEGDKHSLLGCLNLVPPLKSSCIERLQAAAKAAEMDPVNSYQAWQLMARGMAMEHGFLSKEHPLQRNHEDTLANAGVLFDKEKREYVLVGADGSKQKMPADLVHSTKVGSQRDLPSKLDPLESSRDFLSHGLNQTLEYNLQGPGNMKEKPTECPDCGRVFRTYHQVVVHSRVHKRDRKGEEDGLHVGLDERRGSGSDQESQSVSRSTTPGSSNVTEESGVGGGLSQTGSAQEDSPHPSSPSSSDIGEEAGRSAGVQQPALLRDRSLGSAMKDCPYCGKTFRTSHHLKVHLRIHTGEKPYKCPHCDYAGTQSASLKYHLERHHRERQNGAGPLSGQPPNQDHKDEMSSKASLFIRPDILRGAFKGLPGIDFRGGPASQQWTSGVLSSGDHSGQATGMSSEVPSDALKGTDLPSKSTHFSEIGRAYQSIVSNGVNFQGSLQAFMDSFVLSSLKKEKDMKDKALADPPSMKVHGVDGGEEKPSGKSSQRKSEKSQYEPLDLSVRPDAASLPGSSVTVQDSIAWHGCLFCAFTTSSMELMALHLQANHLGKAKRKDNTIGVTVNCKDQAREASKMALLPSLQSNKDLGLSNMISSLDSASEKMAQGQLKETLGEQKSGAWTGHVDPAFCNFPSDFYKQFGVYPGMVGSGASSSCPNKEPDGKAHSEEDVPILIPETTSKNTTDDLSDIASSEDMDSSKGENNDEEDVETEPEMMTKPLSALSKDSSSDGGDSLQPTGTSQPVQGLVSPLSQAPEKQWHSQGLLQAQDPLAGLPKPERGPQSLDKPMNMLSVLRAYSSDGLAAFNGLASSTANSGCIKRPDLCGK

SEQ ID NO: 16231 - protein, 660 aa, Homo Sapiens
MAHALVTFRDVAIDFSQKEWECLDTTQRKLYRDVMLENYNNLVSLGYSGSKPDVITLLEQGKEPCVVARDVTGRQCPGLLSRHKTKKLSSEKDIHEISLSKESIIEKSKTLRLKGSIFRNEWQNKSEFEGQQGLKERSISQKKIVSKKMSTDRKRPSFTLNQRIHNSEKSCDSHLVQHGKIDSDVKHDCKECGSTFNNVYQLTLHQKIHTGEKSCKCEKCGKVFSHSYQLTLHQRFHTGEKPYECQECGKTFTLYPQLNRHQKIHTGKKPYMCKKCDKGFFSRLELTQHKRIHTGKKSYECKECGKVFQLIFYFKEHERIHTGKKPYECKECGKAFSVCGQLTRHQKIHTGVKPYECKECGKTFRLSFYLTEHRRTHAGKKPYECKECGKSFNVRGQLNRHKTIHTGIKPFACKVCEKAFSYSGDLRVHSRIHTGEKPYECKECGKAFMLRSVLTEHQRLHTGVKPYECKECGKTFRVRSQISLHKKIHTDVKPYKCVRCGKTFRFGFYLTEHQRIHTGEKPYKCKECGKAFIRRGNLKEHLKIHSGLKPYDCKECGKSFSRRGQFTEHQKIHTGVKPYKCKECGKAFSRSVDLRIHQRIHTGEKPYECKQCGKAFRLNSHLTEHQRIHTGEKPYECKVCRKAFRQYSHLYQHQKTHNVI

SEQ ID NO: 16232 - protein, 1346 aa, Homo Sapiens
MDQYSLGDEGALPSEMHLPSFSESQGLNCSDTLNRDLGPNTRGFLYAGLSGLDPDPSLPTPDMSSEVLEDNLDTLSLYSGKDSDSVKLLEEYADSESQASLQDLGLGVLKAKEADEGGRATSGSARKGKRQHSSPQNPLLDCSLCGKVFSSASSLSKHYLTHSQERKHVCKICSKAFKRQDHLTGHMLTHQKTKPFVCIEQGCSKSYCDYRSLRRHYEVHHGLCILKEAPPEEEACGDSPHAHESAGQPPPSSLRSLVPPEARSPGSLLPHRDLLRRIVSSIVHQKTPSPGPAPAGASDSEGRNTACPCPASSGSSSCTPAGPHAAPAALDTELPEEPCLPQKEPATDVFTAPNSRAAENGAPDPPEPEPDTALLQARSTAECWPEGGSVPACLPLFRGQTVPASSQPSSHSFQWLRNLPGCPKSKGNNVFVVHKPSAVPSREGSESGPGPSSGSPSEESPPGPGGGLEDALPFPAALLRVPAEAPSDPRSASGEDDPCAPKKVKVDCDSFLCQNPGEPGLQEAQKAGGLPADASPLFRQLFLKSQEPLVSHEQMQVFQMITKSQRIFSHAQVAAVSSQLPAPEGKPAALRPLQGPWPQQPPPLAPAVDSLHAGPGNPEAEGSPARRRKTTPGVPREASPGSTRRDAKGGLKVAAVPTPLAAPSLDPSRNPDISSLAKQLRSSKGTLDLEDIFPSTGQRQTQLGGEEPPGASLPGKQAPAENGAASRITKGEKGPACSRGGGYRLLGNPRAPRFSGFRKEKAKMDMCCAASPSQVAMASFSSAGPPADPSKSKLTIFSRIQGGNIYRLPHPVKEENVAGRGNQQNGSPTDWTKPRSTFVCKNCSQMFYTEKGLSSHMCFHSDQWPSPRGKQEPQVFGTEFCKPLRQVLRPEGDRHSPPGTKKPLDPTAAAPLVVPQSIPVVPVTRHIGSMAMGQEKDGEERDSKESSQQRKRKKRPPPSTAGEPGPAGCHQSRLRSPMFLVDCLLKGLFQCSPYTPPPMLSPIREGSGVYFNTLCSTSTQASPDQLISSMLDQVDGSFGICVVKDDTKISIEPHINIGSRFQAEIPELQERSLAGTDEHVASLVWKPWGDMMISSETQDRVTELCNVACSSVMPGGGTNLELALHCLHEAQGNVQVALETLLLRGPHKPRTHLLADYRYTGSDVWTPIEKRLFKKAFYAHKKDFYLIHKMIQTKTVAQCVEYYYIWKKMIKFDCGRAPGLEKRVKREPEEVERTEEKVPCSPRERPSHHPTPKLKTKSYRRESILSSSPNAGSKRTPELLGSAESQGIFPCRECERVFDKIKSRNAHMKRHRLQDHVEPIIRVKWPVKPFQLKEEELGADIGPLQW

SEQ ID NO: 16233 - protein, 170 aa, Homo Sapiens
MLENYQNLVWLGLSISKSVISLLEKRKLPWIMAKEEIRGPLPGYFKVSEMTISQEPKAKTRTLFGKDVPGAEIKELSAKRAINEVLSQFDTVIKCTRNVCKECGNLYCHNMQLTLHKRNHTQKKCNQCLDCGKYFTRQSTLIQHQRIHTGERPYKCNECIKTFNQRAHLT

SEQ ID NO: 16234 - protein, 600 aa, Homo Sapiens
MAASAQVSVTFEDVAVTFTQEEWGQLDAAQRTLYQEVMLETCGLLMSLGCPLFKPELIYQLDHRQELWMATKDLSQSSYPGDNTKPKTTEPTFSHLALPEEVLLQEQLTQGASKNSQLGQSKDQDGPSEMQEVHLKIGIGPQRGKLLEKMSSERDGLGSDDGVCTKITQKQVSTEGDLYECDSHGPVTDALIREEKNSYKCEECGKVFKKNALLVQHERIHTQVKPYECTECGKTFSKSTHLLQHLIIHTGEKPYKCMECGKAFNRRSHLTRHQRIHSGEKPYKCSECGKAFTHRSTFVLHHRSHTGEKPFVCKECGKAFRDRPGFIRHYIIHTGEKPYECIECGKAFNRRSYLTWHQQIHTGVKPFECNECGKAFCESADLIQHYIIHTGEKPYKCMECGKAFNRRSHLKQHQRIHTGEKPYECSECGKAFTHCSTFVLHKRTHTGEKPYECKECGKAFSDRADLIRHFSIHTGEKPYECVECGKAFNRSSHLTRHQQIHTGEKPYECIQCGKAFCRSANLIRHSIIHTGEKPYECSECGKAFNRGSSLTHHQRIHTGRNPTIVTDVGRPFMTAQTSVNIQELLLGKEFLNITTEENLW

SEQ ID NO: 16235 - protein, 715 aa, Homo Sapiens
MEARSMLVPPQASVCFEDVAMAFTQEEWEQLDLAQRTLYREVTLETWEHIVSLGLFLSKSDVISQLEQEEDLCRAEQEAPRDWKATLEENRLNSEKDRAREELSHHVEVYRSGPEEPPSLVLGKVQDQSNQLREHQENSLRFMVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGSSLCFHGRTFSVKKSDDCKDYGNLFSHSVSLNEQKPVHFGKSQYECDECRETCSESLCLVQTERSGPGETPFRCEERCAAFPMASSFSDCNIIQTTEKPSVCNQCGKSFSCCKLIHQRTHTGEKPFECTQCGKSFSQSYDLVIHQRTHTGEKPYECDLCGKSFTQRSKLITHQRIHTGEKPYQCIECRKSFRWNSNLIVHQRIHTGEKPYECTHCGKSFSQSYELVTHKRTHTGEKPFKCTQCGKSFSQKYDLVVHQRTHTGEKPYECNLCGKSFSQSSKLITHQRIHTGEKPYQCIECGKSFRWNSNLVIHQRIHTGEKPYDCTHCGKSFSQSYQLVAHKRTHTGEKPYECNECGKAFNRSTQLIRHLQIHTGEKPYKCNQCNKAFARSSYLVMHQRTHTGEKPFECSQCGKAFSGSSNLLSHHRIHSGEKPYECSDCGKSFRQQSQLVVHRRTHTGEKP

SEQ ID NO: 16236 - protein, 836 aa, Homo Sapiens
MQVDPPLHGPPNDFLIFQIIPLHSLSIMPRFLWILCFSMEETQGELTSSCGSKTMANVSLAFRDVSIDLSQEEWECLDAVQRDLYKDVMLENYSNLVSLGYTIPKPDVITLLEQEKEPWIVMREGTRNWFTDLEYKYITKNLLSEKNVCKIYLSQLQTGEKSKNTIHEDTIFRNGLQCKHEFERQERHQMGCVSQMLIQKQISHPLHPKIHAREKSYECKECRKAFRQQSYLIQHLRIHTGERPYKCMECGKAFCRVGDLRVHHTIHAGERPYECKECGKAFRLHYHLTEHQRIHSGVKPYECKECGKAFSRVRDLRVHQTIHAGERPYECKECGKAFRLHYQLTEHQRIHTGERPYECKVCGKTFRVQRHISQHQKIHTGVKPYKCNECGKAFSHGSYLVQHQKIHTGEKPYECKECGKSFSFHAELARHRRIHTGEKPYECRECGKAFRLQTELTRHHRTHTGEKPYECKECGKAFICGYQLTLHLRTHTGEIPYECKECGKTFSSRYHLTQHYRIHTGEKPYICNECGKAFRLQGELTRHHRIHTCEKPYECKECGKAFIHSNQFISHQRIHTSESTYICKECGKIFSRRYNLTQHFKIHTGEKPYICNECGKAFRFQTELTQHHRIHTGEKPYKCTECGKAFIRSTHLTQHHRIHTGEKPYECTECGKTFSRHYHLTQHHRGHTGEKPYICNECGNAFICSYRLTLHQRIHTGELPYECKECGKTFSRRYHLTQHFRLHTGEKPYSCKECGNAFRLQAELTRHHIVHTGEKPYKCKECGKAFSVNSELTRHHRIHTGEKPYQCKECGKAFIRSDQLTLHQRNHISEEVLCIM

SEQ ID NO: 16237 - protein, 402 aa, Homo Sapiens
MAEMNPAQGHVVFEDVAIYFSQEEWGHLDEAQRLLYRDVMLENLALLSSLGCCHGAEDEEAPLEPGVSVGVSQVMAPKPCLSTQNTQPCETCSSLLKDILRLAEHDGTHPEQGLYTCPAHLHQHQKEQIREKLSRGDGGRPTFVKNHRVHMAGKTFLCSECGKAFSHKHKLSDHQKIHTGERTYKCSKCGILFMERSTLNRHQRTHTGERPYECNECGKAFLCKSHLVRHQTIHSGERPYECSECGKLFMWSSTLITHQRVHTGKRPYGCSECGKFFKCNSNLFRHYRIHTGKRSYGCSECGKFFMERSTLSRHQRVHTGERPYECNECGKFFSLKSVLIQHQRVHTGERPYECSECGKAFLTKSHLICHQTVHTAAKQCSECGKFFRYNSTLLRHQKVHTG

SEQ ID NO: 16238 - protein, 533 aa, Homo Sapiens
MNLTEGRVVFEDVAIYFSQEEWGHLDEAQRLLYRDVMLENLALLSSLGSWHGAEDEEAPSQQGFSVGVSEVTASKPCLSSQKVHPSETCGPPLKDILCLVEHNGIHPEQHIYICEAELFQHPKQQIGENLSRGDDWIPSFGKNHRVHMAEEIFTCMEGWKDLPATSCLLQHQGPQSEWKPYRDTEDREAFQTGQNDYKCSECGKTFTCSYSFVEHQKIHTGERSYECNKCGKFFKYSANFMKHQTVHTSERTYECRECGKSFMYNYRLMRHKRVHTGERPYECNTCGKFFRYSSTFVRHQRVHTGERPYECRECGKFFMDSSTLIKHQRVHTGERPYKCNDCGKFFRYISTLIRHQRIHTGERPYECSVCGELFRYNSSLVKHWRNHTGERPYKCSECGKSFRYHCRLIRHQRVHTGERPYECSECGKFFRYNSNLIKHWRNHTGERPYECRECGKAFSHKHILVEHQKIHSGERPYECSECQKAFIRKSHLVHHQKIHSEERLVCSMNVGNSLAKTPTSLNIRDFTMEKVYH

SEQ ID NO: 16239 - protein, 640 aa, Homo Sapiens
MAEAALVITPQIPMVTEEFVKPSQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQQHQNQDSGEKHIRKEESSALLLNSCKIPLSDNLFPCKDVEKDFPTILGLLQHQTTHSRQEYAHRSRETFQQRRYKCEQVFNEKVHVTEHQRVHTGEKAYKRREYGKSLNSKYLFVEHQRTHNAEKPYVCNICGKSFLHKQTLVGHQQRIHTRERSYVCIECGKSLSSKYSLVEHQRTHNGEKPYVCNVCGKSFRHKQTFVGHQQRIHTGERPYVCMECGKSFIHSYDRIRHQRVHTGEGAYQCSECGKSFIYKQSLLDHHRIHTGERPYECKECGKAFIHKKRLLEHQRIHTGEKPYVCIICGKSFIRSSDYMRHQRIHTGERAYECSDCGKAFISKQTLLKHHKIHTRERPYECSECGKGFYLEVKLLQHQRIHTREQLCECNECGKVFSHQKRLLEHQKVHTGEKPCECSECGKCFRHRTSLIQHQKVHSGERPYNCTACEKAFIYKNKLVEHQRIHTGEKPYECGKCGKAFNKRYSLVRHQKVHITEEP

SEQ ID NO: 16240 - protein, 422 aa, Homo Sapiens
MAETKDAAQMLVTFKDVAVTFTREEWRQLDLAQRTLYREVMLETCGLLVSLGHRVPKPELVHLLEHGQELWIVKRGLSHATCAGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 16241 - protein, 407 aa, Homo Sapiens
MAAAALRFPVQGTVTFEDVAVKFTQEEWNLLSEAQRCLYRDVTLENLALMSSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLLRSGLLQQEATHTGKSNSKTECVSLFHGGKSHYSCGGCMKHFSTKDILSQHERLLPTEEPSVWCECGKSSSKYDSFSNHQGVHTREKPYTCGICGKLFNSKSHLLVHQRIHTGEKPYECEVCQKFFRHKYHLIAHQRVHTGERPYECSDCGKSFTHSSTFRVHKRVHTGQKPYECSECGKSFAESSSLTKHRRVHTGEKPYGCSECEKKFRQISSLRHHQRVHKRKGL

SEQ ID NO: 16242 - protein, 538 aa, Homo Sapiens
MVTCAHLGRRARLPAAQPSACPGTCFSQEERMAAGYLPRWSQELVTFEDVSMDFSQEEWELLEPAQKNLYREVMLENYRNVVSLEALKNQCTDVGIKEGPLSPAQTSQVTSLSSWTGYLLFQPVASSHLEQREALWIEEKGTPQASCSDWMTVLRNQDSTYKKVALQEEPASGINMIKLIREDGGWKQLEDSHEDPQGLLSQKASLHVVAVPQEKATAWHGFGENGNLSPALVLSQGSSKGNHLCGSELDITSLASDSVLNHHQLGYADRRPCESNECGNAIRQNSHFIQHGGKMFVYLENGQSLNHGMALTIHNKINTAEKPFECHQCGKVFNRRHSLSEHQRIHTGEKPYECQECGRAFTHSSTLTRHLRTHTGEKPYGCGECGKAFNRISSLTQHQRIHTGEKPYKCEDCGKSFCQSSYLILHKRTHTGEKPYECSECGKAFSDRSSLNQHERTHTGENPYECKQCGRAFSQRSSLVRHERTHTGEKPYRCQECGKAFSQSSSLVTHQKTHSSQKTYKIIDCGKAFYQNRHLIGY

SEQ ID NO: 16243 - protein, 628 aa, Homo Sapiens
MDSVVFEDVAVDFTLEEWALLDSAQRDLYRDVMLETFQNLASVDDETQFKASGSVSQQDIYGEKIPKESKIATFTRNVSWASVLGKIWDSLSIEDQTTNQGRNLSRNHGLERLCESNDQCGEALSQIPHLNLYKKIPPGVKQYEYNTYGKVFMHRRTSLKSPITVHTGHKPYQCQECGQAYSCRSHLRMHVRTHNGERPYVCKLCGKTFPRTSSLNRHVRIHTAEKTYECKQCGKAFIDFSSLTSHLRSHTGEKPYKCKECGKAFSYSSTFRRHTITHTGEKPYKCKECAEAFSYSSTFRRHMISHTGEKPHKCKECGEAFSYSSAFRRHMITHTGEKPYECKQCGKTFIYLQSFRRHERIHTGEKPYECKQCGKTFIYPQSFRRHERTHGGEKPYECNQCGKAFSHPSSFRGHMRVHTGEKPYECKQCGKTFNWPISLRKHMRTHTREKPYECKQCGKAFSLSACFREHVRMHPEDKSYECKLCGKAFYCHISLQKHMRRHTAEKLYKCKQCGKAFSWPELLQQHVRTHTVEKPYECKECGKVFKWPSSLPIHMRLHTGEKPYQCKHCGKAFNCSSSLRRHVRIHTTEKQYKCNVGHPPANEFMCSASEKSHQERDLIKVVNMVLPL

SEQ ID NO: 16244 - protein, 456 aa, Homo Sapiens
MDTVVFEDVVVDFTLEEWALLNPAQRKLYRDVMLETFKHLASVDNEAQLKASGSISQQDTSGEKLSLKQKIEKFTRKNIWASLLGKNWEEHSVKDKHNTKERHLSRNPRVERPCKSSKGNKRGRTFRKTRNCNRHLRKNCCTSVRRYECSQCGKLFTHSSSLIRHKRAHSGQKLYKCKECGKAFSRPSYLQTHEKTHSGEKPYACQSCGKTFLRSHSLTEHVRTHTGEKPYECGQCGKGFSCPKSFRAHVMMHAGGRPYECKHCGKAFRCQKSFRVHMIMHAGGRPYECKQCGKAYCWATSFQRHVRIHNGEKPYKCGKCGKAFGWPSSLHKHARTHAKKKPVSGGSVGKSSARPRPSTDVKSQTREKVYKCETCGKTYGWSSSLHKHERKHTGEKPVNAASVGKPSGGLCSSKNVRTQIGQKPSKCEKCGKAFSCPKAFQGHVRSHTGKKSCTSK

SEQ ID NO: 16245 - protein, 423 aa, Homo Sapiens
MAAVVLPPTAASQREGHTEGGELVNELLKSWLKGLVTFEDVAVEFTQEEWALLDPAQRTLYRDVMLENCRNLASLGNQVDKPRLISQLEQEDKVMTEERGILSGTCPDVENPFKAKGLTPKLHVFRKEQSRNMKMERNHLGATLNECNQCFKVFSTKSSLTRHRKIHTGERPYGCSECGKSYSSRSYLAVHKRIHNGEKPYECNDCGKTFSSRSYLTVHKRIHNGEKPYECSDCGKTFSNSSYLRPHLRIHTGEKPYKCNQCFREFRTQSIFTRHKRVHTGEGHYVCNQCGKAFGTRSSLSSHYSIHTGEYPYECHDCGRTFRRRSNLTQHIRTHTGEKPYTCNECGKSFTNSFSLTIHRRIHNGEKSYECSDCGKSFNVLSSVKKHMRTHTGKKPYECNYCGKSFTSNSYLSVHTRMHNRQM

SEQ ID NO: 16246 - protein, 402 aa, Homo Sapiens
MAAVILPSTAAPSSLFPASQQKGHTQGGELVNELLTSWLRGLVTFEDVAVEFTQEEWALLDPAQRTLYRDVMLENCRNLASLGCRVNKPSLISQLEQDKKVVTEERGILPSTCPDLETLLKAKWLTPKKNVFRKEQSKGVKTERSHRGVKLNECNQCFKVFSTKSNLTQHKRIHTGEKPYDCSQCGKSFSSRSYLTIHKRIHNGEKPYECNHCGKAFSDPSSLRLHLRIHTGEKPYECNQCFHVFRTSCNLKSHKRIHTGENHHECNQCGKAFSTRSSLTGHNSIHTGEKPYECHDCGKTFRKSSYLTQHVRTHTGEKPYECNECGKSFSSSFSLTVHKRIHTGEKPYECSDCGKAFNNLSAVKKHLRTHTGEKPYECNHCGKSFTSNSYLSVHKRIHNRWI

SEQ ID NO: 16247 - protein, 538 aa, Homo Sapiens
MVAGWLTNYSQDSVTFEDVAVDFTQEEWTLLDQTQRNLYRDVMLENYKNLVAVDWESHINTKWSAPQQNFLQGKTSSVVEMERNHFGEELFDFNQCEKALSEHSCLKTHRRTYFRKKTCECNQCEKAFRKPSIFTLHKKTDIGEELPNCNQCETAFSQHLHLVCKKTSQNLHLVCKKTHTQEKPYKCSDCEKGLPSSSHLRECVRIYGGERPYTHKEYVETFSHSTALFVHMQTQDGEKFYECKACGKPFTESSYLTQHLRTHSRVLPIEHKKFGKAFAFSPDLAKHIRLRTRGKHYVCNECGKEFTCFSKLNIHIRVHTGEKPYECNKCGKAFTDSSGLIKHRRTHTGEKPYECKECGKAFANSSHLTVHMRTHTGEKPYQCKECGKAFINSSSFKSHMQTHPGVKPYDCQQCGKAFIRSSFLIRHLRSHSAERPFECEECGKAFRYSSHLSQHKRIHTGERPYKCQKCGQAFSISSGLTVHMRTHTGERPFECQECGKAFTRSTYLIRHLRSHSVEKPYKECGQTFSNSSCLTECV

SEQ ID NO: 16248 - protein, 161 aa, Homo Sapiens
MGPLQFRDVAIEFSLEEWHCLDTAQWNLYRDVMLENYRHLVFLVCGKAFNSSSNLTTHKKIHTGEKPYRCEECGKAFKRSSHLTVHKIVHTGEKSYKCEECGKAFKHPSHVTAHKKIHTGGKPYKCEECGKDFKYTSTLIAHKRIHTGEKPYKCEECGKDF

SEQ ID NO: 16249 - protein, 790 aa, Homo Sapiens
MAYCLTNCYQYSVTFEDTAVDFTQEEWILLDPVQRNLYRDVMLENYENVAKVGFQLFKPSVISWLEEEELRTLQQGVLQDWAIKHQTSVSALQQEFWKIQTSNGIQMDLVTFDSVAVEFTQEEWTLLDPAQRNLYSDVMLENYKNLSSVGYQLFKPSLISWLEEEEELSTLPRVLQEWKMCLKTKGPALWQDNFCLKTLNGIQLARNQNGEELYDCKQCEDVFCKHPCLKTNMSTQNRGNTSECIQYAKDLLSLYNKTSTIRKVSVFSKHGKSFRLILNVQVQRKCTQDKSFEGTDYGKAFIYQSYLEAHRKTQSGEKLNEWKQCGEAFTHSTSHAVNVETHIIKNPYECKECGKDFRYPTHLNNHMQTHIGIKPYKCKHCGKTFTVPSGFLEHVRTHTGEKPYGCKECGKAFGTSAGLIEHIRCHAREKTFKCDHCGKAFISYPSLFGHLRVHNGEKPYEHKEYGKAFGTSSGVIEDRRSNTGQKRFDCDQCGKVFVSFSSLFAHLRTHTGEKPFKCYKCGKPFTSSACLRIHMRTHTEERLYQCKKCGKAFTKCSYLTKHLRTHAGEKPYECMKCGKAFTERSYLTKHLRRHSGEKPYECKKCGKAFTERSDLTKHLRRHTGDKPYEYKDCGKAFVVSSSLVDHLRTHTGYKPYKCNACEKAYSRSCVLTQHLKTHAAEKTSECNACGNSFRNSMCFHDRLKTLTKIKPYKCKDCGKAFTCHSDLTNHVRIHTGEKPYKCKECGKAFRTSSGRIQHLRTHMGEKPFECDQCGKAFASFSARIAHLKTH

SEQ ID NO: 16250 - protein, 486 aa, Homo Sapiens
MAAIYLSRGFFSREPICPFEEKTKVERMVEDYLASGYQDSVTFDDVAVDFTPEEWALLDTTEKYLYRDVMLENYMNLASVEWEIQPRTKRSSLQQGFLKNQIFSGIQMTRGYSGWKLCDCKNCGEVFREQFCLKTHMRVQNGGNTSEGNCYGKDTLSVHKEASTGQELSKFNPCGKVFTLTPGLAVHLEVLNARQPYKCKECGKGFKYFASLDNHMGIHTDEKLCEFQEYGRAVTASSHLKQCVAVHTGKKSKKTKKCGKSFTNFSQLYAPVKTHKGEKSFECKECGRSFRNSSCLNDHIQIHTGIKPHKCTYCGKAFTRSTQLTEHVRTHTGIKPYECKECGQAFAQYSGLSIHIRSHSGKKPYQCKECGKAFTTSTSLIQHTRIHTGEKPYECVECGKTFITSSRRSKHLKTHSGEKPFVCKICGKAFLYSSRLNVHLRTHTGEKPFVCKECGKAFAVSSRLSRHERIHTGEKPYECKDMSVTI

SEQ ID NO: 16251 - protein, 426 aa, Homo Sapiens
MSAFDMSHGFFPREPICPFEEKTKIGTMVEDHRSNSYQDSVTFDDVAVEFTPEEWALLDTTQKYLYRDVMLENYMNLASVDFFFCLTSEWEIQPRTKRSSLQQGFLKNQIFTGIQMQTRSYSGWKLCENCGEVFSEQFCLKTHMRAQNGGNTFEGNCYGKDSISVHKEASIGQELSKFNPCGKVFTLTPGLAVHLEILNGRQPYKCKECGKGFKYFASLDNHMGIHIGEKLCEFQECERAITTSSHLKQCVAVHTGKKSEKTKNCGKSFTNFSQLSAHAKTHKGEKSFECKECGRSFRNSSSFNVHIQIHTGIKPHKCTECGKAFTRSTHLTQHVRTHTGIKPYECKECGQAFTQYTGLAIHIRNHTGEKPYQCKECGKAFNRSSTLTQHRRIHTGEKPYECVECGKTFITSSHRSKHLKTHSGER

SEQ ID NO: 16252 - protein, 476 aa, Homo Sapiens
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYECKQCSKALPDSSSYIRHERTHTGEKPYTCKQCGKAFSVSSSLRRHETTHSAEKPYECKQCGKTFHHLGSFQIHMKRHTGDRPHKCKICGKGFDRPSLVRYHERIHTGEKPYECKQCGKTLSHSSSFRRHMIMHTGGGPHKCKICGKAFVYPSVCQRHEKSHSGEKPYECKQCGKALSHSSSFRRHMVMHTGDGPNKCKVCGKAFVYPSVCQRHEKTHWRETI

SEQ ID NO: 16253 - protein, 553 aa, Homo Sapiens
MDSVASEDVAVNFTLEEWALLDPSQKKLYRDVMRETFRNLACVGKKWEDQSIEDWYKNQGRILRNHMEEGLSESKEYDQCGEAFSQILNLNLNKKIPTIVRPCECSLCGKVFMHHSSLSRHIRSHLGHKPYDYQEYGEKPYKCKQCGKAFSSCQSFRRHERTHTGEKPYACPECGKAFISLPSVRRHMIKHTGDGPYKCQECGKAFDRPSLFQIHERTHTGEKPYECQECAKAFISLPSFQRHMIRHTGDGPYKCQECGKAFDRPSLFRIHERTHTGEKPHECKQCGKAFISFTNFQSHMIRHTGDGPYKCKVCGRAFIFPSYVRKHERTHTGEKPYECNKCGKTFSSSSNVRTHERTHTGEKPYECKECGKAFISLPSVRRHMIKHTGDGPYKCQVCGRAFDCPSSFQIHERTHTGEKPYECQVCGKAFISLKRIRKHMILHTGDGPYKCQVCGKAFDCPSSVRTHERTHTGEKPYECKECGKAFNYASSIRIHERTHTGEKPYECKQCGKTFSYSSSFQRHERAHNGDKPYVKNVGKLSFITQPSNTCENE

SEQ ID NO: 16254 - protein, 539 aa, Homo Sapiens
MRRGPWERWSLASHRLDAGLCTCPREESREIRAGQIVLKAMAQGLVTFRDVAIEFSLEEWKCLEPAQRDLYREVTLENFGHLASLGLSISKPDVVSLLEQGKEPWMIANDVTGPWCPDLESRCEKFLQKDIFEIGAFNWEIMESLKCSDLEGSDFRADWECEGQFERQVNEECYFKQVNVTYGHMPVFQHHTSHTVRQSRETGEKLMECHECGKAFSRGSHLIQHQKIHTGEKPFGCKECGKAFSRASHLVQHQRIHTGEKPYDCKDCGKAFGRTSELILHQRLHTGVKPYECKECGKTFRQHSQLILHQRTHTGEKPYVCKDCGKAFIRGSQLTVHRRIHTGARPYECKECGKAFRQHSQLTVHQRIHTGEKPYECKECGKGFIHSSEVTRHQRIHSGEKPYECKECGKAFRQHAQLTRHQRVHTGDRPYECKDCGKAFSRSSYLIQHQRIHTGDKPYECKECGKAFIRVSQLTHHQRIHTCEKPYECRECGMAFIRSSQLTEHQRIHPGIKPYECRECGQAFILGSQLIEHYRIHTG

SEQ ID NO: 16255 - protein, 418 aa, Homo Sapiens
MAQESVMFSDVSVDFSQEEWECLNDDQRDLYRDVMLENYSNLVSMGHSISKPNVISYLEQGKEPWLADRELTRGQWPVLESRCETKKLFLKKEIYEIESTQWEIMEKLTRRDFQCSSFRDDWECNRQFKKELGSQGGHFNQLVFTHEDLPTLSHHPSFTLQQIINSKKKFCASKEYRKTFRHGSQFATHEIIHTIEKPYECKECGKSFRHPSRLTHHQKIHTGKKPFECKECGKTFICGSDLTRHHRIHTGEKPYECKECGKAFSSGSNFTRHQRIHTGEKPYECKECGKAFSSGSNFTQHQRIHTGEKPYECKECGNAFSQSSQLIKHQRIHTGEKPYECKECEKAFRSGSDLTRHQRIHTGEKPYECKICGKAYSQSSQLISHHRIHTSEKPYEYRECGKNFNYDPQLIQHQNLYW

SEQ ID NO: 16256 - protein, 647 aa, Homo Sapiens
MAQGSVSFNDVTVDFTQEEWQHLDHAQKTLYMDVMLENYCHLISVGCHMTKPDVILKLERGEEPWTSFAGHTCLEENWKAEDFLVKFKEHQEKYSRSVVSINHKKLVKEKSKIYEKTFTLGKNPVNSKNLPPEYDTHGRILKNVSELIISNLNPARKRLSEYNGYGKSLLSTKQETTHPEVKSHNQSARAFSHNEVLMQYQKTETPAQSFGYNDCEKSFLQRGGLITHSRPYKGENPSVYNKKRRATNIEKKHTCNECGKSFCRKSVLILHQGIHSEEKPYQCHQCGNAFRRKSYLIDHQRTHTGEKPFVCNECGKSFRLKTALTDHQRTHTGEKSYECLQCRNAFRLKSHLIRHQRTHTGEKPYECNDCGKSFRQKTTLSLHQRIHTGEKPYICKECGKSFHQKANLTVHQRTHTGEKPYICNECGKSFSQKTTLALHEKTHNEEKPYICSECGKSFRQKTTLVAHQRTHTGEKSYECPHCGKAFRMKSYLIDHHRTHTGEKPYECNECGKSFSQKTNLNLHQRIHTGEKPYVCNECGKSFRQKATLTVHQKIHTGQKSYECPQCGKAFSRKSYLIHHQRTHTGEKPYKCSECGKCFRQKTNLIVHQRTHTGEKPYVCNECGKSFSYKRNLIVHQRTHKGENIEMQ

SEQ ID NO: 16257 - protein, 644 aa, Homo Sapiens
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKECGKAFSRKENLITHQKIHTGEKPYKCNECGKAFIQMSNLIRHHRIHTGEKPYACKDCWKAFSQKSNLIEHERIHTGEKPYECKECGKSFSQKQNLIEHEKIHTGEKPYACNECGRAFSRMSSVTLHMRSHTGEKPYKCNKCGKAFSQCSVFIIHMRSHTGEKPYVCSECGKAFSQSSSLTVHMRNHTAEKPYECKECGKAFSRKENLITHQKIHTGEKPYECSECGKAFIQMSNLIRHQRIHTGEKPYACTVCGKAFSQKSNLTEHEKIHTGEKPYHCNQCGKAFSQRQNLLEHEKIHTGEKPFKCNECGKAFSRISSLTLHVRSHTGEKPYECNKCGKAFSQCSLLIIHMRSHTGEKPFECNECGKAFSQRASLSIHKRGHTGERHQVY

SEQ ID NO: 16258 - protein, 686 aa, Homo Sapiens
MTESQGTVTFKDVAIDFTQEEWKRLDPAQRKLYRNVMLENYNNLITVGYPFTKPDVIFKLEQEEEPWVMEEEVLRRHWQGEIWGVDEHQKNQDRLLRQVEVKFQKTLTEEKGNECQKKFANVFPLNSDFFPSRHNLYEYDLFGKCLEHNFDCHNNVKCLMRKEHCEYNEPVKSYGNSSSHFVITPFKCNHCGKGFNQTLDLIRHLRIHTGEKPYECSNCRKAFSHKEKLIKHYKIHSREQSYKCNECGKAFIKMSNLIRHQRIHTGEKPYACKECEKSFSQKSNLIDHEKIHTGEKPYECNECGKAFSQKQSLIAHQKVHTGEKPYACNECGKAFPRIASLALHMRSHTGEKPYKCDKCGKAFSQFSMLIIHVRIHTGEKPYECNECGKAFSQSSALTVHMRSHTGEKPYECKECRKAFSHKKNFITHQKIHTREKPYECNECGKAFIQMSNLVRHQRIHTGEKPYICKECGKAFSQKSNLIAHEKIHSGEKPYECNECGKAFSQKQNFITHQKVHTGEKPYDCNECGKAFSQIASLTLHLRSHTGEKPYECDKCGKAFSQCSLLNLHMRSHTGEKPYVCNECGKAFSQRTSLIVHMRGHTGEKPYECNKCGKAFSQSSSLTIHIRGHTGEKPFDCSKCGKAFSQISSLTLHMRKHTGEKPYHCIECGKAFSQKSHLVRHQRIHTH

SEQ ID NO: 16259 - protein, 555 aa, Homo Sapiens
MDSVVFEDVAVDFTLEEWALLDSAQRDLYRDVMLETFRNLASVDDGTQFKANGSVSLQDMYGQEKSKEQTIPNFTGNNSCAYTLEKNCEGYGTEDHHKNLRNHMVDRFCTHNEGNQYGEAIHQMPDLTLHKKVSAGEKPYECTKCRTVFTHLSSLKRHVKSHCGRKAPPGEECKQACICPSHLHSHGRTDTEEKPYKCQACGQTFQHPRYLSHHVKTHTAEKTYKCEQCRMAFNGFASFTRHVRTHTKDRPYKCQECGRAFIYPSTFQRHMTTHTGEKPYKCQHCGKAFTYPQAFQRHEKTHTGEKPYECKQCGKTFSWSETLRVHMRIHTGDKLYKCEHCGKAFTSSRSFQGHLRTHTGEKPYECKQCGKAFTWSSTFREHVRIHTQEQLYKCEQCGKAFTSSRSFRGHLRTHTGEKPYECKQCGKTFTWSSTFREHVRIHTQEQLHKCEHCGKAFTSSRAFQGHLRMHTGEKPYECKQCGKTFTWSSTLHNHVRMHTGEKPHKCKQCGMSFKWHSSFRNHLRMHTGQKSHECQSYSKAFSCQVILSKTSESTH

SEQ ID NO: 16260 - protein, 536 aa, Homo Sapiens; identical to SEQ ID NO: 14444

SEQ ID NO: 16261 - protein, 609 aa, Homo Sapiens
MPHLLVTFRDVAIDFSQEEWECLDPAQRDLYRDVMLENYSNLISLDLESSCVTKKLSPEKEIYEMESLQWENMGKRINHHLQYNGLGDNMECKGNLEGQEASQEGLYMCVKITCEEKATESHSTSSTFHRIIPTKEKLYKCKECRQGFSYLSCLIQHEENHNIEKCSEVKKHRNTFSKKPSYIQHQRIQTGEKPYECMECGKAFGRTSDLIQHQKIHTNEKPYQCNACGKAFIRGSQLTEHQRVHTGEKPYECKKCGKAFSYCSQYTLHQRIHSGEKPYECKDCGKAFILGSQLTYHQRIHSGEKPYECKECGKAFILGSHLTYHQRVHTGEKPYICKECGKAFLCASQLNEHQRIHTGEKPYECKECGKTFFRGSQLTYHLRVHSGERPYKCKECGKAFISNSNLIQHQRIHTGEKPYKCKECGKAFICGKQLSEHQRIHTGEKPFECKECGKAFIRVAYLTQHEKIHGEKHYECKECGKTFVRATQLTYHQRIHTGEKPYKCKECDKAFIYGSQLSEHQRIHRGEKPYECKQCGKAFIRGSHLTEHLRTHTGEKPYECKECGRAFSRGSELTLHQRIHTGEKPYTCVQCGKDFRCPSQLTQHTRLHN

SEQ ID NO: 16262 - protein, 529 aa, Homo Sapiens
MEQEKKLLVSDSNSFMERESLKSPFTGDTSMNNLETVHHNNSKADKLKEKPSEWSKRHRPQHYKHEDAKEMPLTWVQDEIWCHDSYESDGKSENWGNFIAKEEEKPNHQEWDSGEHTNACVQQNSSFVDRPYKCSECWKSFSNSSHLRTHQRTHSGEKPYKCSECAKCFCNSSHLIQHLRMHTGEKPYQCGECGKSFSNTSHLIIHERTHTGEKPYKCPECGKRFSSSSHLIQHHRSHTGEKPYECSVCGKGFSHSYVLIEHQRTHTGEKPYKCPDCGKSFSQSSSLIRHQRTHTGEKPYKCLECEKSFGCNSTLIKHQRIHTGEKPYQCPECGKNFSRSSNLITHQKMHTGEKSYESSEYEESLGQNCNVIEECRIQLGEKPYRCCECGKSFGLSSHLIRHQRTHTGEKPYRCSECWKTFSQSSTLVIHQRTHTGEKPYKCPDCGESFSQSFNLIRHRRTHIGEKPYKCTSCEKCFSRSAYLSQHRKIHVEKPFESPDVGDFPHEWTWKNCSGEMPFISSFSVSNSSS

SEQ ID NO: 16263 - protein, 665 aa, Homo Sapiens
MFPVLEPHQVGLIRSYNSKTMTCFQELVTFRDVAIDFSRQEWEYLDPNQRDLYRDVMLENYRNLVSLGGHSISKPVVVDLLERGKEPWMILREETQFTDLDLQCEIISYIEVPTYETDISSTQLQSIYKREKLYECKKCQKKFSSGYQLILHHRFHVIERPYECKECGKNFRSGYQLTLHQRFHTGEKPYECTECGKNFRSGYQLTVHQRFHTGEKTYECRQCGKAFIYASHIVQHERIHTGGKPYECQECGRAFSQGGHLRIHQRVHTGEKPYKCKECGKTFSRRSNLVEHGQFHTDEKPYICEKCGKAFRRGHQLTVHQRVHTGKKPYECKECGKGYTTASYFLLHQRIHKGGKPYECKECKKTFTLYRNLTRHQNIHTGEKLFECKQCGKTYTTGSKLFQHQKTHTGEKPYECKECGKAFSLYGYLKQHQKIHTGMKHFECKECKKTFTLYRNLTRHQNIHTGKKLFECQECGKAYSTGSNLIQHRKTHTGEKPYKCKECGKTFSLHGYLNQHQKIHTGMKPYECKVCRKTFTFYRNLTLHQSIHTDEKPFECKECGKTFRRSSHLTAHQSIHADKKPYECKECGKAFKMYGYLTQHQKIHTGGKPYECKECGKAFSRASNLVQHERIHTGEKPYVCKQCGKTFRYGSALKAHQRIHRSIKV

SEQ ID NO: 16264 - protein, 896 aa, Homo Sapiens
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQASSPAEVPVSQPDPLPASDHSYELRNGEAIGRDRRGRRARRNNSGEAGGAATQELFCSACDQLFLSPHQLQQHLRSHREGVFKCPLCSRVFPSPSSLDQHLGDHSSESHFLCVDCGLAFGTEALLLAHRRAHTPNPLHSCPCGKTFVNLTKFLYHRRTHGVGGVPLPTTPVPPEEPVIGFPEPAPAETGEPEAPEPPVSEETSAGPAAPGTYRCLLCSREFGKALQLTRHQRFVHRLERRHKCSICGKMFKKKSHVRNHLRTHTGERPFPCPDCSKPFNSPANLARHRLTHTGERPYRCGDCGKAFTQSSTLRQHRLVHAQHFPYRCQECGVRFHRPYRLLMHRYHHTGEYPYKCRECPRSFLLRRLLEVHQLVVHAGRQPHRCPSCGAAFPSSLRLREHRCAAAAAQAPRRFECGTCGKKVGSAARLQAHEAAHAAAGPGEVLAKEPPAPRAPRATRAPVASPAALGSTATASPAAPARRRGLECSECKKLFSTETSLQVHRRIHTGERPYPCPDCGKAFRQSTHLKDHRRLHTGERPFACEVCGKAFAISMRLAEHRRIHTGERPYSCPDCGKSYRSFSNLWKHRKTHQQQHQAAVRQQLAEAEAAVGLAVMETAVEALPLVEAIEIYPLAEAEGVQISG

SEQ ID NO: 16265 - protein, 245 aa, Homo Sapiens
MLERGAESAAGATDPSPTGKEPVTKEAPHQGPPQKPSQSAPGPTASAGSPPRPRRRPPPQRPHRCPDCDKAFSYPSKLATHRLAHGGARPHPCPDCPKAFSYPSKLAAHRLTHSGARPHPCPHCPKSFGHRSKLAAHLWTHAPTRPYPCPDCPKSFCYPSKLAAHRHTHHATDARPYPCPHCPKAFSFPSKLAAHRLCHDPPTAPGSQATAWHRCSSCGQAFGQRRLLLLHQRSHHQVEHKGERD

SEQ ID NO: 16266 - protein, 715 aa, Homo Sapiens
MSSPKRSSKPSMSLAPSGSSMPTADPKPPASLKSTKSATPNRSLVPTKPATSRNSVMSPSSSKSTKSTSTKRAPSNRPSSRSRVRSKARTPSRVSTDTRTSKASKASDVRCHQRRGTHSRGRTPGRRGSRSSKRSPSRASTPGRIRTHGARPGMASRVRTPTSQQKGSRGKSYGRPRTSNRERSDSQPRNLSKKSYRPPGGSGIGRSSELAVTPSTAKCQTPTGIPSKEKSDNPSPSSSRKVKSYGQMIIPSREKSYSPTEMSSRVKSYNQASTRSRPQSHSQSRSPRRSRSGSQKRTHSRVRSHSWKRNHSRARSRTRKGILSQMGRHSQSRSHSKGKSQNQSRTPRRGRSHNWSRNPSKERSHSHSRSSSKERDHRGSSSPRKESGRSQSGSPNKQRDHSRSRSPNKARDRSRSRSPYKARDRSRSRSPNKARDCSRSRSPYKARDRSRSRSPNKARDHSRSRSPNKARDRSRSRSPSKERDHSQLGSPSKERDHRRSRSPSKERQCRQSRSSSKERDHRRSRSPSKERQRRQSRSPNKERDRSQSRSPSEEREHRQSRSPSKERDRRRWRSPSKERERRQSRSSSEERDHSRSRSPNKQSGYSRPRASSKEKAHSRSRTPSKEGNHSQSRTSSKESDPSQSTVPRSPDWKRSPTRTSSLSQNRTPSKTSSHSPSTFPSGGQTLSQDDSQADATTSKATLPGERSSSSSSKLA

SEQ ID NO: 16267 - protein, 170 aa, Homo Sapiens
MEDPNPEENMKQQDSPKERSPQSPGGNICHLGAPKCTRCLITFADSKFQERHMKREHPADFVAQKLQGVLFICFTCARSFPSSKALITHQRSHGPAAKPTLPVATTTAQPTFPCPDCGKTFGQAVSLRRHRQMHEVRAPPGTFACTECGQDFAQEAGLHQHYIRHARGEL

SEQ ID NO: 16268 - protein, 485 aa, Homo Sapiens
MKNATIVMSVRREQGSSSGEGSLSFEDVAVGFTREEWQFLDQSQKVLYKEVMLENYINLVSIGYRGTKPDSLFKLEQGEPPGIAEGAAHSQICPGFVIQSRRYAGKDSDAFGGYGRSCLHIKRDKTLTGVKYHRCVKPSSPKSQLNDLQKICAGGKPHECSVCGRAFSRKAQLIQHQRTERGEKPHGCGECGKTFMRKIQLTEHQRTHTGEKPHECSECGKAFSRKSQLMVHQRTHTGEKPYRCSKCGKAFSRKCRLNRHQRSHTGEKLYGCSVCGKAFSQKAYLTAHQRLHTGDKPYKCSDCGRTFYFKSDLTRHQRIHTGEKPYECSECEKAFRSKSKLIQHQRTHTGERPYSCRECGKAFAHMSVLIKHEKTHIRETAINSLTVEKPSSRSHTSLYMSELIQEQKTVNTVPIEMPSSGTPPLLNKSERLVGRNVVIVEQPFPRNQAFVVNQEFEQRISLTNEVNVAPSVINYILYLTDIVSE

SEQ ID NO: 16269 - protein, 590 aa, Homo Sapiens
MLHEEAAQKRKGKEPGMALPQGRLTFRDVAIEFSLAEWKFLNPAQRALYREVMLENYRNLEAVDISSKRMMKEVLSTGQGNTEVIHTGMLQRHESYHTGDFCFQEIEKDIHDFEFQSQKDERNGHEASMPKIKELMGSTDRHDQRHAGNKPIKDQLGLSFHLHLPELHIFQPEEKIANQVEKSVNDASSISTSQRISCRPETHTPNNYGNNFFHSSLLTQKQEVHMREKSFQCNETGEAFNCSSFVRKHQIIHLGEKQYKFDICGKVFNEKRYLARHRRCHTSEKPYKCNECGKSFSYKSSLTCHRRCHTGEKPYKCNECGKSFSYKSSLTCHHRCHTGEKPYKCNECGKSFSYKSSLRCHRRLHTGIKPYKCNECGKMFGQNSTLVIHKAIHTGEKPYKCNECGKAFNQQSHLSRHHRLHTGEKPYKCNDCGKAFIHQSSLARHHRLHTGEKSYKCEECDRVFSQKSNLERHKIIHTGEKPYKCNECHKTFSHRSSLPCHRRLHSGEKPYKCNECGKTFNVQSHLSRHHRLHTGEKPYKCKVCDKAFMCHSYLANHTRIHSGEKPYKCNECGKAHNHLIDSSIKPCMSS

SEQ ID NO: 16270 - protein, 562 aa, Homo Sapiens
MDPQPPPPAQGSPPHRGRGRGRGRGRGRGRGRGRGGAGAPRAPLPCPTCGRLFRFPYYLSRHRLSHSGLRPHACPLCPKAFRRPAHLSRHLRGHGPQPPLRCAACPRTFPEPAQLRRHLAQEHAGGEVELAIERVAKETAEPSWGPQDEGSEPPTTAAAGATEEEAVAAWPETWPAGEPSTLAAPTSAAEPRESESEEAEAGAAELRAELALAAGRQEEKQVLLQADWTLLCLRCREAFATKGELKAHPCLRPEGEQEGEGGPPPRPKRHQCSICLKAFARPWSLSRHRLVHSTDRPFVCPDCGLAFRLASYLRQHRRVHGPLSLLAPLPAAGKKDDKASGARNSAKGPEGGEGAECGGASEGGEGQNGGDAAPARPPAGEPRFWCPECGKGFRRRAHLRQHGVTHSGARPFQCVRCQREFKRLADLARHAQVHAGGPAPHPCPRCPRRFSRAYSLLRHQRCHRAELERAAALQALQAQAPTSPPPPPPPLKAEQEEEGLPLPLANIKEEPPSPGTPPQSPPAPPVFLSASCFDSQDHSAFEMEEEEVDSKAHLRGLGGLAS

SEQ ID NO: 16271 - protein, 172 aa, Homo Sapiens
MLLLPPRPPHPRSSSPEAMDPPPPKAPPFPKAEGPSSTPSSAAGPRPPRLGRHLLIDANGVPYTYTVQLEEEPRGPPQREAPPGEPGPRKGYSCPECARVFASPLRLQSHRVSHSDLKPFTCGACGKAFKRSSHLSRHRATHRARAGPPHTCPLCPRRFQDAAELAQHVRLH

SEQ ID NO: 16272 - protein, 197 aa, Homo Sapiens
MLVLPSPCPQPLAFSSVETMEGPPRRTCRSPEPGPSSSIGSPQASSPPRPNHYLLIDTQGVPYTVLVDEESQREPGASGAPGQKKCYSCPVCSRVFEYMSYLQRHSITHSEVKPFECDICGKAFKRASHLARHHSIHLAGGGRPHGCPLCPRRFRDAGELAQHSRVHSGERPFQCPHCPRRFMEQNTLQKHTRWKHP

SEQ ID NO: 16273 - protein, 517 aa, Homo Sapiens
MSLGSELFRDVAIVFSQEEWQWLAPAQRDLYRDVMLETYSNLVSLGLAVSKPDVISFLEQGKEPWMVERVVSGGLCPVLESRYDTKELFPKQHVYEVESPQWEIMESLTSYGLECSSFQDDWECRNQFDRQQGNPDRHFHQMIIRHEEMPTFDQHASLTFYQKIHTREKPFGYNKCRKDFWQKELLINHQGIYTNEKPYKCKECGKAFKYGSRLIQHENIHSGKKPYECKECGKAFNSGSNFIQHQRVHTGEKPYECKDCEKAFSRSSQLIEHQRTHTGEKPYQCKECGKAFNRISHLKVHYRIHTGEKPYACKECGKTFSHRSQLIQHQTVHTGRKLYECKECGKAFNQGSTLIRHQRIHTGEKPYECKVCGKAFRVSSQLKQHQRIHTGEKPYQCKVCGRAFKRVSHLTVHYRIHTGEKPYECKECGKAFSHCSQLIHHQVIHTEKKPYEYKECEKTLSHDSTTVQPQRMHNRETHVNIINVEKPSISSYPLLIIREFMLASNHMNGSNGESPLA

SEQ ID NO: 16274 - protein, 569 aa, Homo Sapiens
MSKDLVTFGDVAVNFSQEEWEWLNPAQRNLYRKVMLENYRSLVSLGVSVSKPDVISLLEQGKEPWMVKKEGTRGPCPDWEYVFKNSEFSSKQETYEESSKVVTVGARHLSYSLDYPSLREDCQSEDWYKNQLGSQEVHLSQLIITHKEILPEVQNKEYNKSWQTFHQDTIFDIQQSFPTKEKAHKHEPQKKSYRKKSVEMKHRKVYVEKKLLKCNDCEKVFNQSSSLTLHQRIHTGEKPYACVECGKTFSQSANLAQHKRIHTGEKPYECKECRKAFSQNAHLAQHQRVHTGEKPYQCKECKKAFSQIAHLTQHQRVHTGERPFECIECGKAFSNGSFLAQHQRIHTGEKPYVCNVCGKAFSHRGYLIVHQRIHTGERPYECKECRKAFSQYAHLAQHQRVHTGEKPYECKVCRKAFSQIAYLDQHQRVHTGEKPYECIECGKAFSNSSSLAQHQRSHTGEKPYMCKECRKTFSQNAGLAQHQRIHTGEKPYECNVCGKAFSYSGSLTLHQRIHTGERPYECKDCRKSFRQRAHLAHHERIHTMESFLTLSSPSPSTSNQLPRPVGFIS

SEQ ID NO: 16275 - protein, 421 aa, Homo Sapiens
MAGEAEAQLDPSLQGLVMFEDVTVYFSREEWGLLNVTQKGLYRDVMLENFALVSSLGLAPSRSPVFTQLEDDEQSWVPSWVDVTPVSRAEARRGFGLDGLCRVEDERAHPEHLKSYRVIQHQDTHSEGKPRRHTEHGAAFPPGSSCGQQQEVHVAEKLFKCSDCGKVFLKAFALLDHLITHSEERPFRCPTGRSAFKKSAHINPRKIHTGETAHVCNECGKAFSYPSKLRKHQKVHTGIKPFKCSDCGKTFNRKDALVLHQRIHTGERPYECSKCGKTFSVLSTLIRHRKVHIGERPYECTECGKFFKYNNSFILHQRVHTGERPFECKQCGKGYVTRSGLYQHWKVHTGERPYECSLCGKTFTTRSYRNRHQQFHTEERSYECTECGKAFKHSSTLLQHKKVHTPERRQEDRAHGKVVSC

SEQ ID NO: 16276 - protein, 769 aa, Homo Sapiens
MPANWTSPQKSSALAPEDHGSSYEGSVSFRDVAIDFSREEWRHLDPSQRNLYRDVMLETYSHLLSVGYQVPEAEVVMLEQGKEPWALQGERPRQSCPGEKLWDHNQCRKILSYKQVSSQPQKMYPGEKAYECAKFEKIFTQKSQLKVHLKVLAGEKLYVCIECGKAFVQKPEFIIHQKTHMREKPFKCNECGKSFFQVSSLFRHQRIHTGEKLYECSQCGKGFSYNSDLSIHEKIHTGERHHECTDCGKAFTQKSTLKMHQKIHTGERSYICIECGQAFIQKTHLIAHRRIHTGEKPYECSNCGKSFISKSQLQVHQRVHTRVKPYICTEYGKVFSNNSNLVTHKKVQSREKSSICTECGKAFTYRSELIIHQRIHTGEKPYECSDCGKAFTQKSALTVHQRIHTGEKSYICMKCGLAFIQKAHLIAHQIIHTGEKPHKCGHCGKLFTSKSQLHVHKRIHTGEKPYMCNKCGKAFTNRSNLITHQKTHTGEKSYICSKCGKAFTQRSDLITHQRIHTGEKPYECNTCGKAFTQKSHLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFTDRSNLNKHQTTHTGDKPYKCGICGKGFVQKSVFSVHQSSHA

SEQ ID NO: 16277 - protein, 769 aa, Homo Sapiens
MPASWTSPQKSSALAPEDHGSSYEGSVSFRDVAIDFSREEWRHLDLSQRNLYRDVMLETYSHLLSVGYQVPKPEVVMLEQGKEPWALQGERPRHSCPGEKLWDHNQHRKIIGYKPASSQDQKIYSGEKSYECAEFGKSFTWKSQFKVHLKVPTGEKLYVCIECGRAFVQKPEFITHQKTHMREKPYKCNECGKSFFQVSSLFRHHRIHTGEKLYECSECGKGFPYNSDLSIHEKIHTGERHHECTDCGKAFTQKSTLKIHQKIHTGERSYICIECGQAFIQKTQLIAHRRIHSGEKPYECNNCGKSFISKSQLQVHQRVHTRVKPYICTEYGKVFSNNSNLITHEKIQSREKSSICTECGKAFTYRSELIIHQRIHTGEKPYECSDCGRAFTQKSALTVHQRIHTGEKSYICMKCGLAFIRKAHLITHQIIHTGEKPYKCGHCGKLFTSKSQLHVHKRIHTGEKPYVCNKCGKAFTNRSNLITHQKTHTGEKSYICSKCGKAFTQRSDLITHQRIHTGEKPYECNTCGKAFTQKSNLNIHQKIHTGERQYECHECGKAFNQKSILIVHQKIHTGEKPYVCTECGRAFIRKSNFITHQRIHTGEKPYECSDCGKSFTSKSQLLVHQPVHTGEKPYVCAECGKAFSGRSNLSKHQKTHTGEKPYICSECGKTFRQKSELITHHRIHTGEKPYECSDCGKSFTKKSQLQVHQRIHTGEKPYVCAECGKAFSNRSNLNKHQTTHTGDKPYKCGICGKGFVQKSVFSVHQSSHA

SEQ ID NO: 16278 - protein, 402 aa, Homo Sapiens
MAAAAALRAPAQSSVTFEDVAVNFSLEEWSLLNEAQRCLYRDVMLETLTLISSLGCWHGGEDEAAPSKQSTCIHIYKDQGGHSGERPYECGEYRKLFKNKSCLTEPRRDHKHRNVRTGERPYECSKYGKLFHQKPTLHIHERFHTGQKTYECSECGKSFHQSSSLLQRQTLHTRERPYECIECGKAFAEKSSLINHRKVHSGAKRYECNECGKSFAYTSSLIKHRRIHTGERPYECSECGRSFAENSSLIKHLRVHTGERPYECVECGKSFRRSSSLLQHQRVHTRERPYECSECGKSFSLRSNLIHHQRVHTGERHECGQCGKSFSRKSSLIIHLRVHTGERPYECSDCGKSFAENSSLIKHLRVHTGERPYECIDCGKSFRHSSSFRRHQRVHTGMRPYK

SEQ ID NO: 16279 - protein, 575 aa, Homo Sapiens
MAAAVPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSFSNHQRDHTAKGPYDCGECGKSYSRKSSLIQHQRVHTGQTAYPCEECGKSFSQKGSLISHQLVHTGEGPYECRECGKSFGQKGNLIQHQQGHTGERAYHCGECGKSFRQKFCFINHQRVHTGERPYKCGECGKSFGQKGNLVHHQRGHTGERPYECKECGKSFRYRSHLTEHQRLHTGERPYNCRECGKLFNRKYHLLVHERVHTGERPYACEVCGKLFGNKHSVTIHQRIHTGERPYECSECGKSFLSSSALHVHKRVHSGQKPYKCSECGKSFSECSSLIKHRRIHTGERPYECTKCGKTFQRSSTLLHHQSSHRRKAL

SEQ ID NO: 16280 - protein, 364 aa, Homo Sapiens
MWAPREQLLGWTAEALPAKDSAWPWEEKPRYLGPVTFEDVAVLFTEAEWKRLSLEQRNLYKEVMLENLRNLVSLAESKPEVHTCPSCPLAFGSQQFLSQDELHNHPIPGFHAGNQLHPGNPCPEDQPQSQHPSDKNHRGAEAEDQRVEGGVRPLFWSTNERGALVGFSSLFQRPPISSWGGNRILEIQLSPAQNASSEEVDRISKRAETPGFGAVTFGECALAFNQKSNLFRQKAVTAEKSSDKRQSQVCRECGRGFSRKSQLIIHQRTHTGEKPYVCGECGRGFIVESVLRNHLSTHSGEKPYVCSHCGRGFSCKPYLIRHQRTHTREKSFMCTVCGRGFREKSELIKHQRIHTGDKPYVCRD

SEQ ID NO: 16281 - protein, 1267 aa, Homo Sapiens
MGDMKTPDFDDLLAAFDIPDPTSLDAKEAIQTPSEENESPLKPPGICMDESVSLSHSGSAPDVPAVSVIVKNTSRQESFEAEKDHITPSLLHNGFRGSDLPPDPHNCGKFDSTFMNGDSARSFPGKLEPPKSEPLPTFNQFSPISSPEPEDPIKDNGFGIKPKHSDSYFPPPLGCGAVGGPVLEALAKFPVPELHMFDHFCKKEPKPEPLPLGSQQEHEQSGQNTVEPHKDPDATRFFGEALEFNSHPSNSIGESKGLARELGTCSSVPPRQRLKPAHSKLSSCVAALVALQAKRVASVTKEDQPGHTKDLSGPTKESSKGSPKMPKSPKSPRSPLEATRKSIKPSDSPRSICSDSSSKGSPSVAASSPPAIPKVRIKTIKTSSGEIKRTVTRILPDPDDPSKSPVGSPLGSAIAEAPSEMPGDEVPVEEHFPEAGTNSGSPQGARKGDESMTKASDSSSPSCSSGPRVPKGAAPGSQTGKKQQSTALQASTLAPANLLPKAVHLANLNLVPHSVAASVTAKSSVQRRSQPQLTQMSVPLVHQVKKAAPLIVEVFNKVLHSSNPVPLYAPNLSPPADSRIHVPASGYCCLECGDAFALEKSLSQHYGRRSVHIEVLCTLCSKTLLFFNKCSLLRHARDHKSKGLVMQCSQLLVKPISADQMFVSAPVNSTAPAAPAPSSSPKHGLTSGSASPPPPALPLYPDPVRLIRYSIKCLECHKQMRDYMVLAAHFQRTTEETEGLTCQVCQMLLPNQCSFCAHQRIHAHKSPYCCPECGVLCRSAYFQTHVKENCLHYARKVGYRCIHCGVVHLTLALLKSHIQERHCQVFHKCAFCPMAFKTASSTADHSATQHPTQPHRPSQLIYKCSCEMVFNKKRHIQQHFYQNVSKTQVGVFKCPECPLLFVQKPELMQHVKSTHGVPRNVDELSSLQSSADTSSSRPGSRVPTEPPATSVAARSSSLPSGRWGRPEAHRRVEARPRLRNTGWTCQECQEWVPDRESYVSHMKKSHGRTLKRYPCRQCEQSFHTPNSLRKHIRNNHDTVKKFYTCGYCTEDSPSFPRPSLLESHISLMHGIRNPDLSQTSKVKPPGGHSPQVNHLKRPVSGVGDAPGTSNGATVSSTKRHKSLFQCAKCSFATDSGLEFQSHIPQHQVDSSTAQCLLCGLCYTSASSLSRHLFIVHKVRDQEEEEEEEAAAAEMAVEVAEPEEGSGEEVPMETRENGLEECAGEPLSADPEARRLLGPAPEDDGGHNDHSQPQASQDQDSHTLSPQV

SEQ ID NO: 16282 - protein, 134 aa, Homo Sapiens
MGRSRRTGAHRAHSLARQMKAKRRRPDLDEIHRELRPQGSARPQPDPNAEFDPDLPGGGLHRCLACARYFIDSTNLKTHFRSKDHKKRLKQLSVEPYSQEEAERAAGMGSYVPPRRLAVPTEVSTEVPEMDTST

SEQ ID NO: 16283 - protein, 807 aa, Homo Sapiens
MKEWKSKMEISEEKKSARAASEKLQRQITQECELVETSNSEDRLLKHWVSPLKDAMRHLPSQESGIREMHIIPQKAIVGEIGHGCNEGEKILSAGESSHRYEVSGQNFKQKSGLTEHQKIHNINKTYECKECEKTFNRSSNLIIHQRIHTGNKPYVCNECGKDSNQSSNLIIHQRIHTGKKPYICHECGKDFNQSSNLVRHKQIHSGGNPYECKECGKAFKGSSNLVLHQRIHSRGKPYLCNKCGKAFSQSTDLIIHHRIHTGEKPYECYDCGQMFSQSSHLVPHQRIHTGEKPLKCNECEKAFRQHSHLTEHQRLHSGEKPYECHRCGKTFSGRTAFLKHQRLHAGEKIEECEKTFSKDEELREEQRIHQEEKAYWCNQCGRNFQGTSDLIRHQVTHTGEKPYECKECGKTFNQSSDLLRHHRIHSGEKPCVCSKCGKSFRGSSDLIRHHRVHTGEKPYECSECGKAFSQRSHLVTHQKIHTGEKPYQCTECGKAFRRRSLLIQHRRIHSGEKPYECKECGKLFIWRTAFLKHQSLHTGEKLECEKTFSQDEELRGEQKIHQEAKAYWCNQCGRAFQGSSDLIRHQVTHTREKPYECKECGKTFNQSSDLLRHHRIHSGEKPYVCNKCGKSFRGSSDLIKHHRIHTGEKPYECSECGKAFSQRSHLATHQKIHTGEKPYQCSECGNAFRRRSLLIQHRRLHSGEKPYECKECGKLFMWHTAFLKHQRLHAGEKLEECEKTFSKDEELRKEQRTHQEKKVYWCNQCSRTFQGSSDLIRHQVTHTREKPYECKECGKTQSELRPSETS

SEQ ID NO: 16284 - protein, 648 aa, Homo Sapiens
MELVTFRDVAIEFSPEEWKCLDPAQQNLYRDVMLENYRNLVSLGFVISNPDLVTCLEQIKEPCNLKIHETAAKPPAICSPFSQDLSPVQGIEDSFHKLILKRYEKCGHENLQLRKGCKRVNECKVQKGVNNGVYQCLSTTQSKIFQCNTCVKVFSKFSNSNKHKIRHTGEKPFKCTECGRSFYMSHLTQHTGIHAGEKPYKCEKCGKAFNRSTSLSKHKRIHTGEKPYTCEECGKAFRRSTVLNEHKKIHTGEKPYKCEECGKAFTRSTTLNEHKKIHTGEKPYKCKECGKAFRWSTSLNEHKNIHTGEKPYKCKECGKAFRQSRSLNEHKNIHTGEKPYTCEKCGKAFNQSSSLIIHRSIHSEQKLYKCEECGKAFTWSSSLNKHKRIHTGEKPYTCEECGKAFYRSSHLAKHKRIHTGEKPYTCEECGKAFNQSSTLILHKRIHSGQKPYKCEECGKAFTRSTTLNEHKKIHTGEKPYKCEECGKAFIWSASLNEHKNIHTGEKPYKCKECGKAFNQSSGLIIHRSIHSEQKLYKCEECGKAFTRSTALNEHKKIHSGEKPYKCKECGKAYNLSSTLTKHKRIHTGEKPFTCEECGKAFNWSSSLTKHKIIHTGEKSYKCEECGKAFNRPSTLTVHKRIHTGKEHS

SEQ ID NO: 16285 - protein, 504 aa, Homo Sapiens
MPSPDSMTFEDIIVDFTQEEWALLDTSQRKLFQDVMLENISHLVSIGKQLCKSVVLSQLEQVEKLSTQRISLLQGREVGIKHQEIPFIQHIYQKGTSTISTMRSHTQEDPFLCNDLGEDFTQHIALTQNVITYMRTKHFVSKKFGKIFSDWLSFNQHKEIHTKCKSYGSHLFDYAFIQNSALRPHSVTHTREITLECRVCGKTFSKNSNLRRHEMIHTGEKPHGCHLCGKAFTHCSDLRKHERTHTGEKPYGCHLCGKAFSKSSNLRRHEMIHTREKAQICHLCGKAFTHCSDLRKHERTHLGDKPYGCLLCGKAFSKCSYLRQHERTHNGEKPYECHLCGKAFSHCSHLRQHERSHNGEKPHGCHLCGKAFTESSVLKRHERIHTGEKPYECHVCGKAFTESSDLRRHERTHTGEKPYECHLCGKAFNHSSVLRRHERTHTGEKPYECNICGKAFNRSYNFRLHRRVHTGEKPYVCPLCGKAFSKFFNLRQHERTHTKKAMNM

SEQ ID NO: 16286 - protein, 424 aa, Homo Sapiens
MASMPPTPEAQGPILFEDLAVYFSQEECVTLHPAQRSLSKDGTKESLEDAALMGEEGKPEINQQLSLESMELDELALEKYPIAAPLVPYPEKSSEDGVGNPEAKILSGTPTYKRRVISLLVTIENHTPLVELSEYLGTNTLSEILDSPWEGAKNVYKCPECDQNFSDHSYLVLHQKIHSGEKKHKCGDCGKIFNHRANLRTHRRIHTGEKPYKCAKCSASFRQHSHLSRHMNSHVKEKPYTCSICGRGFMWLPGLAQHQKSHSAENTYESTNCDKHFNEKPNLALPEETFVSGPQYQHTKCMKSFRQSLYPALSEKSHDEDSERCSDDGDNFFSFSKFKPLQCPDCDMTFPCFSELISHQNIHTEERPHKCKTCEESFALDSELACHQKSHMLAEPFKCTVCGKTFKSNLHLITHKRTHIKNTT

SEQ ID NO: 16287 - protein, 904 aa, Homo Sapiens
MAAAGGAEGRRAALEAAAAAAPERGGGSCVLCCGDLEATALGRCDHPVCYRCSTKMRVLCEQRYCAVCREELRQVVFGKKLPAFATIPIHQLQHEKKYDIYFADGKVYALYRQLLQHECPRCPELPPFSLFGDLEQHMRRQHELFCCRLCLQHLQIFTYERKWYSRKDLARHRMQGDPDDTSHRGHPLCKFCDERYLDNDELLKHLRRDHYFCHFCDSDGAQDYYSDYAYLREHFREKHFLCEEGRCSTEQFTHAFRTEIDLKAHRTACHSRSRAEARQNRHIDLQFSYAPRHSRRNEGVVGGEDYEEVDRYSRQGRVARAGTRGAQQSRRGSWRYKREEEDREVAAAVRASVAAQQQEEARRSEDQEEGGRPKKEEAAARGPEDPRGPRRSPRTQGEGPGPKETSTNGPVSQEAFSVTGPAAPGCVGVPGALPPPSPKLKDEDFPSLSASTSSSCSTAATPGPVGLALPYAIPARGRSAFQEEDFPALVSSVPKPGTAPTSLVSAWNSSSSSKKVAQPPLSAQATGSGQPTRKAGKGSRGGRKGGPPFTQEEEEDGGPALQELLSTRPTGSVSSTLGLASIQPSKVGKKKKVGSEKPGTTLPQPPPATCPPGALQAPEAPASRAEGPVAVVVNGHTEGPAPARSAPKEPPGLPRPLGSFPCPTPQEDFPALGGPCPPRMPPPPGFSAVVLLKGTPPPPPPGLVPPISKPPPGFSGLLPSPHPACVPSPATTTTTKAPRLLPAPRAYLVPENFRERNLQLIQSIRDFLQSDEARFSEFKSHSGEFRQGLISAAQYYKSCRDLLGENFQKVFNELLVLLPDTAKQQELLSAHTDFCNREKPLSTKSKKNKKSAWQATTQQAGLDCRVCPTCQQVLAHGDASSHQALHAARDDDFPSLQAIARIIT

SEQ ID NO: 16288 - protein, 588 aa, Homo Sapiens
MAAPALALVSFEDVVVTFTGEEWGHLDLAQRTLYQEVMLETCRLLVSLGHPVPKPELIYLLEHGQELWTVKRGLSQSTCAGEKAKPKITEPTASQLAFSEESSFQELLAQRSSRDSRLGQARDEEKLIKIQEGNLRPGTNPHKEICPEKLSYKHDDLEPDDSLGLRVLQERVTPQDALHECDSQGPGKDPMTDARNNPYTCTECGKGFSKKWALVRHQQIHAGVKPYECNECGKACRYMADVIRHMRLHTGEKPYKCIECGKAFKRRFHLTEHQRIHTGDKPYECKECGKAFTHRSSFIQHNMTHTREKPFLCKECGKAFYYSSSFAQHMRIHTGKKLYECGECGKAFTHRSTFIQHNVTHTGEKPFLCKECGKTFCLNSSFTQHMRIHTGEKPYECGECGKAFTHRSTFIRHKRTHTGEKPFECKECGKAFCDSSSLIQHMRIHTGEKPYECSECGKAFTHHSVFIRHNRTHSGQKPLECKECAKAFYYSSSFTRHMRIHTGEKPYVCRECGKAFTQPANFVRHNRIHTGEKPFECKECEKAFCDNFALTQHMRTHTGEKPFECNECGKTFSHSSSFTHHRKIHTRV

SEQ ID NO: 16289 - protein, 722 aa, Homo Sapiens
MMKEVLSTGQGNTEVIHTGTLQRYQSYHIGDFCFQEIEKEIHDIEFQCQEDERNGHEAPMTKIKKLTGSTDQHDHRHAGNKPIKDQLGSSFYSHLPELHIIQIKGKIGNQFEKSTSDAPSVSTSQRISPRPQIHISNNYGNNSPNSSLLPQKQEVYMREKSFQCNESGKAFNCSSLLRKHQIPHLGDKQYKCDVCGKLFNHKQYLTCHCRCHTGEKPYKCNECGKSFSQVSSLTCHRRLHTAVKSHKCNECGKIFGQNSALVIHKAIHTGEKPYKCNECDKAFNQQSNLARHRRIHTGEKPYKCEECDKVFSRKSTLESHKRIHTGEKPYKCKVCDTAFTWNSQLARHKRIHTGEKTYKCNECGKTFSHKSSLVCHHRLHGGEKSYKCKVCDKAFAWNSHLVRHTRIHSGGKPYKCNECGKTFGQNSDLLIHKSIHTGEQPYKYEECEKVFSCGSTLETHKIIHTGEKPYKCKVCDKAFACHSYLAKHTRIHSGEKPYKCNECSKTFRLRSYLASHRRVHSGEKPYKCNECSKTFSQRSYLHCHRRLHSGEKPYKCNECGKTFSHKPSLVHHRRLHTGEKSYKCTVCDKAFVRNSYLARHTRIHTAEKPYKCNECGKAFNQQSQLSLHHRIHAGEKLYKCETCDKVFSRKSHLKRHRRIHPGKKPYKCKVCDKTFGSDSHLKQHTGLHTGEKPYKCNECGKAFSKQSTLIHHQAVHGVGKLD

SEQ ID NO: 16290 - protein, 641 aa, Homo Sapiens
MIQSQISFEDVAVDFTLEEWQLLNPTQKNLYRDVMLENYSNLVFLEVWLDNPKMWLRDNQDNLKSMERGHKYDVFGKIFNSSINIVHVGLRSHKCGTGEKSLKCPFDLLIPKNNCERKKIDELNKKLLFCIKPGRTHGGIKYCDCSTCRKSSNEEPWLTANHITHTGVYLCMECGRFFNKKSQLVIHQRTHTGEKPYQCSECGKAFSQKSLLTVHQRTHSGEKPHGCSECQKAFSRKSLLILHQRIHTGEKPYGCSECGKAFSRKSQLKRHQITHTIEKPYSCSECGKAFSQKLKLITHQRAHTGEKPYPCSHCGKAFFWKSQLITHQRTHTGKKPYGCGECQKAFSRNSLLIRHQRIHTGEKPYECNECGEAFIRKPQLIKHQITHTGEKNYRCSDCEEAFFKKSELIRHQKIHLGEKPYGCIQCGKTFFGKSQLLTHHRTHTGEKPYECSECGKAFTQKSSLISHQRTHTGEKPYECSECRKTFSEKSSLIHHQRTHTGEKPFECSECRKAFAWKPQLLRHQRIHTGEKPYECSECGKAFVQKVQLIKHQRNHTGEKTYGCSDCAKAFFEKAQLIIHQRIHTGERPYKCGECGKSFTRKSHLMRHQRIHTGDKYYGCNECGTTFNRKSQLMIHQRNHII

SEQ ID NO: 16291 - protein, 792 aa, Homo Sapiens
MAAINPWASWGALTDQSWGMTAVDPWASWALCPQYPAWHVEGSLEEGRRATGLPAAQVQEPVTFKDVAVDFTQEEWGQLDLVQRTLYRDVMLETYGHLLSVGNQIAKPEVISLLEQGEEPWSVEQACPQRTCPEWVRNLESKALIPAQSIFEEEQSHGMKLERYIWDDPWFSRLEVLGCKDQLEMYHMNQSTAMRQMVFMQKQVLSQRSSEFCGLGAEFSQNLNFVPSQRVSQIEHFYKPDTHAQSWRCDSAIMYADKVTCENNDYDKTVYQSIQPIYPARIQTGDNLFKCTDAVKSFNHIIHFGDHKGIHTGEKLYEYKECHQIFNQSPSFNEHPRLHVGENQYNYKEYENIFYFSSFMEHQKIGTVEKAYKYNEWEKVFGYDSFLTQHTSTYTAEKPYDYNECGTSFIWSSYLIQHKKTHTGEKPYECDKCGKVFRNRSALTKHERTHTGIKPYECNKCGKAFSWNSHLIVHKRIHTGEKPYVCNECGKSFNWNSHLIGHQRTHTGEKPFECTECGKSFSWSSHLIAHMRMHTGEKPFKCDECEKAFRDYSALSKHERTHSGAKPYKCTECGKSFSWSSHLIAHQRTHTGEKPYNCQECGKAFRERSALTKHEIIHSGIKPYECNKCGKSCSQMAHLVRHQRTHTGEKPYECNKCGKSFSQSCHLVAHRRIHTGEKPYKCNQCERSFNCSSHLIAHRRTHTGEKPYRCNECGKAFNESSSLIVHLRNHTGEKPYKCNHCEKAFCKNSSLIIHQRMHSGEKRFICSECGKAFSGHSALLQHQRNHSEEKLN

SEQ ID NO: 16292 - protein, 696 aa, Homo Sapiens
MSYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFECNKCGKSFRLKAGLKVHQSIHTGEKPHECKECGKAFRQFSHLVGHKRIHTGEKPYECKECGKGFTCRYQLTMHQRIYSGEKHYECKENGEAFSSGHQLTAPHTFESVEKPYKCEECGKAFSVHGRLTRHQGIHSGKKPYECNKCGKSFRLNSSLKIHQNIHTGEKPYKCKECGKAFSQRAHLAHHNRIHTGYKPFECKECGKSFRCASYLVIHERIHTGEKPYVCQECGKGFSYSHKLTIHRRVHTGEKPYECKECGKAFSVSGQLTQHLSIHSGKKPFECNKCGKSFRFISVLKAHQNIHSAEKPYECKECGKAFRHATSLIYHDRTHAGEKSYECKECGETFSHASHLIIHERIHTSDKPYECKRCGKAFHCASYLVRHESVHADGNPYMCEECGKAFNSSHELSIHHRVHTGEKPFKCNKCRRSFRLRSILEVHQRIHI

SEQ ID NO: 16293 - protein, 1512 aa, Homo Sapiens
MSVNISTAGKGVDPNTVDTYDSGDDWEIGVGNLIIDLDADLEKDRQKFEMNNSTTTTSSSNSKDCGGPASSGAGATAALADGLKFASVQASAPQGNSHKETSKSKVKRSKTSKDANKSLPSAALYGIPEISSTGKRQEVQGRPGEATGMNSALGQSVSSGGSGNPNSNSTSTSTSAATAGAGSCGKSKEEKPGKSQSSRGAKRDKDAGKSRKDKHDLLQGHQNGSGSQAPSGGHLYGFGAKSNGGGASPFHCGGTGSGSVAAAGEVSKSAPDSGLMGNSMLVKKEEEEEESHRRIKKLKTEKVDPLFTVPAPPPPISSSLTPQILPSYFSPSSSNIAAPVEQLLVRTRSVGVNTCEVGVVTEPECLGPCEPGTSVNLEGIVWHETEEGVLVVNVTWRNKTYVGTLLDCTKHDWAPPRFCESPTSDLEMRGGRGRGKRARSAAAAPGSEASFTESRGLQNKNRGGANGKGRRGSLNASGRRTPPNCAAEDIKASPSSTNKRKNKPPMELDLNSSSEDNKPGKRVRTNSRSTPTTPQGKPETTFLDQGCSSPVLIDCPHPNCNKKYKHINGLRYHQAHAHLDPENKLEFEPDSEDKISDCEEGLSNVALECSEPSTSVSAYDQLKAPASPGAGNPPGTPKGKRELMSNGPGSIIGAKAGKNSGKKKGLNNELNNLPVISNMTAALDSCSAADGSLAAEMPKLEAEGLIDKKNLGDKEKGKKATNCKTDKNLSKLKSARPIAPAPAPTPPQLIAIPTATFTTTTTGTIPGLPSLTTTVVQATPKSPPLKPIQPKPTIMGEPITVNPALVSLKDKKKKEKRKLKDKEGKETGSPKMDAKLGKLEDSKGASKDLPGHFLKDHLNKNEGLANGLSESQESRMASIKAEADKVYTFTDNAPSPSIGSASRLECSTLVNGQAPMAPLHVLTQNGAESSAAKTSSPAYSDISDAADDGGSDSRSEGMRSKASSPSDIISSKDSVVKGHSSTTAQSSQLKESHSPYYHSYDPYYSPSYMHPGQVGAPAAGNSGSTQGMKIKKESEEDAEKKDKAEQLDSKKVDHNSASLQPQHQSVITQRHPALAQSLYYGQYAYGLYMDQKSLMATSPAYRQQYEKYYEDQRLAEQKMAQTGRGDCERKSELPLKELGKEETKQKNMPSATISKAPSTPEPNKNHSKLGPSVPNKTEETGKSQLLSNHQQQLQADSFKAKQMENHQLIKEAVEMKSVMDSMKQTGVDPTSRFKQDPDSRTWHHYVYQPKYLDQQKSEELDREKKLKEDSPRKTPNKESGVPSLPVSLTSIKEEPKEAKHPDSQSMEESKLKNDDRKTPVNWKDSRGTRVAVSSPMSQHQSYIQYLHAYPYPQMYDPSHPAYRAVSPVLMHSYPGAYLSPGFHYPVYGKMSGREETEKVNTSPSVNTKTTTESKALDLLQQHANQYRSKSPAPVEKATAEREREAERERDRHSPFGQRHLHTHHHTHVGMGYPLIPGQYDPFQGLTSAALVASQQVAAQASASGMFPGQRRE

SEQ ID NO: 16294 - protein, 1411 aa, Homo Sapiens
MSLSSGASGGKGVDANPVETYDSGDEWDIGVGNLIIDLDADLEKDQQKLEMSGSKEVGIPAPNAVATLPDNIKFVTPVPGPQGKEGKSKSKRSKSGKDTSKPTPGTSLFTPSEGAASKKEVQGRSGDGANAGGLVAAIAPKGSEKAAKASRSVAGSKKEKENSSSKSKKERSEGVGTCSEKDPGVLQPVPLGGRGGQYDGSAGVDTGAVEPLGSIAIEPGAALNPLGTKPEPEEGENECRLLKKVKSEKMESPVSTPAVLPIHLLVPVVNNDISSPCEQIMVRTRSVGVNTCDVALATEPECLGPCEPGTSVNLEGIVWQETEDGMLVVNVTWRNKTYVGTLLDCTRHDWAPPRFCDSPTSDLEMRNGRGRGKRMRPNSNTPVNETATASDSKGTSNSSKTRAGANSKGRRGSQNSSEHRPPASSTSEDVKASPSSANKRKNKPLSDMELNSSSEDSKGSKRVRTNSMGSATGPLPGTKVEPTVLDRNCPSPVLIDCPHPNCNKKYKHINGLKYHQAHAHTDDDSKPEADGDSEYGEEPILHADLGSCNGASVSQKGSLSPARSATPKVRLVEPHSPSPSSKFSTKGLCKKKLSGEGDTDLGALSNDGSDDGPSVMDETSNDAFDSLERKCMEKEKCKKPSSLKPEKIPSKSLKSARPIAPAIPPQQIYTFQTATFTAASPGSSSGLTATVAQAMPNSPQLKPIQPKPTVMGEPFTVNPALTPAKDKKKKDKKKKESSKELESPLTPGKVCRAEEGKSPFRESSGDGMKMEGLLNGSSDPHQSRLASIKAEADKIYSFTDNAPSPSIGGSSRLENTTPTQPLTPLHVVTQNGAEASSVKTNSPAYSDISDAGEDGEGKVDSVKSKDAEQLVKEGAKKTLFPPQPQSKDSPYYQGFESYYSPSYAQSSPGALNPSSQAGVESQALKTKRDEEPESIEGKVKNDICEEKKPELSSSSQQPSVIQQRPNMYMQSLYYNQYAYVPPYGYSDQSYHTHLLSTNTAYRQQYEEQQKRQSLEQQQRGVDKKAEMGLKEREAALKEEWKQKPSIPPTLTKAPSLTDLVKSGPGKAKEPGADPAKSVIIPKLDDSSKLPGQAPEGLKVKLSDASHLSKEASEAKTGAECGRQAEMDPILWYRQEAEPRMWTYVYPAKYSDIKSEDERWKEERDRKLKEERSRSKDSVPKEDGKESTSSDCKLPTSEESRLGSKEPRPSVHVPVSSPLTQHQSYIPYMHGYSYSQSYDPNHPSYRSMPAVMMQNYPGSYLPSSYSFSPYGSKVSGGEDADKARASPSVTCKSSSESKALDILQQHASHYKSKSPTISDKTSQERDRGGCGVVGGGGSCSSVGGASGGERSVDRPRTSPSQRLMSTHHHHHHLGYSLLPAQYNLPYAAGLSSTAIVASQQGSTPSLYPPPRR

SEQ ID NO: 16295 - protein, 462 aa, Homo Sapiens
MLCDEEAQKRKAKESGMALPQGRLTFMDVAIEFSQEEWKSLDPGQRALYRDVMLENYRNLVFLGICLPDLSIISMLKQRREPLILQSQVKIVKNTDGRECVRSVNTGRSCVLGSNAENKPIKNQLGLTLEAHLSELQLFQAGRKIYRSNQVEKFTNHRSSVSPLQKISSSFTTHIFNKYRNDLIDFPLLPQEEKAYIRGKSYEYECSEDGEVFRVRASLTNHQVIHTAEKPYKCTECGKVFSRNSHLVEHWRIHTGQKPYKCSECDKVFNRNSNLARHQRIHTGEKPHKCNECGKAFRECSGLTTHLVIHTGEKPYKCNECGKNFRHKFSLTNHQRSHTAEKPYKCNECGKVFSLLSYLARHQIIHSTEKPYKCNECGRAFHKRPGLMAHLLIHTGEKPYKCNECDKVFGRKLYLTNHQRIHTGERPYKCNACGKVFNQNPHLSRHRKIHAGENSLRTLQME

SEQ ID NO: 16296 - protein, 705 aa, Homo Sapiens
MLREEAAQKRKGKEPGMALPQGRLTFRDVAIEFSLAEWKCLNPSQRALYREVMLENYRNLEAVDISSKCMMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISCRPQTQISNNYGNNPLNSSLLPQKQEVHMREKSFQCNKSGKAFNCSSLLRKHQIPHLGDKQYKCDVCGKLFNHEQYLACHDRCHTVEKPYKCKECGKTFSQESSLTCHRRLHTGVKRYNCNECGKIFGQNSALLIDKAIDTGENPYKCNECDKAFNQQSQLSHHRIHTGEKPYKCEECDKVFSRKSTIETHKRIHTGEKPYRCKVCDTAFTWHSQLARHRRIHTAKKTYKCNECGKTFSHKSSLVCHHRLHGGEKSYKCKVCDKAFVWSSQLAKHTRIDCGEKPYKCNECGKTFGQNSDLLIHKSIHTGEQPYKCDECEKVFSRKSSLETHKIGHTGEKPYKCKVCDKAFACHSYLAKHTRIHSGEKPYKCNECSKTFSHRSYLVCHHRVHSGEKPYKCNECSKTFSRRSSLHCHRRLHSGEKPYKCNECGNTFRHCSSLIYHRRLHTGEKSYKCTICDKAFVRNSLLSRHTRIHTAEKPYKCNECGKAFNQQSHLSRHHRIHTGEKP

SEQ ID NO: 16297 - protein, 617 aa, Homo Sapiens
MIKSQESLTLEDVAVEFTWEEWQLLGPAQKDLYRDVMLENYSNLVSVGYQASKPDALFKLEQGEPWTVENEIHSQICPEIKKVDNHLQMHSQKQRCLKRVEQCHKHNAFGNIIHQRKSDFPLRQNHDTFDLHGKILKSNLSLVNQNKRYEIKNSVGVNGDGKSFLHAKHEQFHNEMNFPEGGNSVNTNSQFIKHQRTQNIDKPHVCTECGKAFLKKSRLIYHQRVHTGEKPHGCSICGKAFSRKSGLTEHQRNHTGEKPYECTECDKAFRWKSQLNAHQKIHTGEKSYICSDCGKGFIKKSRLINHQRVHTGEKPHGCSLCGKAFSKRSRLTEHQRTHTGEKPYECTECDKAFRWKSQLNAHQKAHTGEKSYICRDCGKGFIQKGNLIVHQRIHTGEKPYICNECGKGFIQKGNLLIHRRTHTGEKPYVCNECGKGFSQKTCLISHQRFHTGKTPFVCTECGKSCSHKSGLINHQRIHTGEKPYTCSDCGKAFRDKSCLNRHRRTHTGERPYGCSDCGKAFSHLSCLVYHKGMLHAREKCVGSVKLENPCSESHSLSHTRDLIQDKDSVNMVTLQMPSVAAQTSLTNSAFQAESKVAIVSQPVARSSVSADSRICTE

SEQ ID NO: 16298 - protein, 585 aa, Homo Sapiens
MIKTQESLTLEDVAVEFSWEEWQLLDTAQKNLYRDVMVENYNHLVSLGYQTSKPDVLSKLAHGQEPWTTDAKIQNKNCPGIGKVDSHLQEHSPNQRLLKSVQQCNGQNTLRNIVHLSKTHFPIVQNHDTFDLYRKNLKSSLSLINQKRRHGINNPVEFIGGEKTLLHGKHERTHTKTRFSENAKCIHTKFQVFKHQRTQKIEKPHACIECEQTFLRKSQLIYHENICIQENPGSGQCEKLSRSVLFTKHLKTNTTDKICIPNEYRKGSTVKSSLITHQQTHTEEKSYMCSECGKGFTMKRYLIAHQRTHSGEKPYVCKECGKGFTVKSNLIVHQRTHTGEKPYICSECGKGFTMKRYLVVHQRTHTGEKPYMCSECGKGFTVKSNLIVHQRSHTGEKSYICSECGKGFTVKRTLVIHQRTHTGEKSYICNECGKGFTTKRTLIIHQRTHTGEKPYECNECGKAFSQKICLIQHERCHTGKTPFVCTECGKSYSHKYGLITHQRIHTGEKPYECNECGKAFTTKSVLNVHQRTHTGERPYGCSDCEKAFSHLSNLVKHKKMHTREMGRISQVENSCNGESQLLPYK

SEQ ID NO: 16299 - protein, 731 aa, Homo Sapiens
MMQAQESLTLEDVAVDFTWEEWQFLSPAQKDLYRDVMLENYSNLVAVGYQASKPDALSKLERGEETCTTEDEIYSRICSEIRKIDDPLQHHLQNQSIQKSVKQCHEQNMFGNIVNQNKGHFLLKQDCDTFDLHEKPLKSNLSFENQKRSSGLKNSAEFNRDGKSLFHANHKQFYTEMKFPAIAKPINKSQFIKQQRTHNIENAHVCSECGKAFLKLSQFIDHQRVHTGEKPHVCSMCGKAFSRKSRLMDHQRTHTELKHYECTECDKTFLKKSQLNIHQKTHMGGKPYTCSQCGKAFIKKCRLIYHQRTHTGEKPHGCSVCGKAFSTKFSLTTHQKTHTGEKPYICSECGKGFIEKRRLTAHHRTHTGEKPFICNKCGKGFTLKNSLITHQQTHTGEKLYTCSECGKGFSMKHCLMVHQRTHTGEKPYKCNECGKGFALKSPLIRHQRTHTGEKPYVCTECRKGFTMKSDLIVHQRTHTAEKPYICNDCGKGFTVKSRLIVHQRTHTGEKPYVCGECGKGFPAKIRLMGHQRTHTGEKPYICNECGKGFTEKSHLNVHRRTHTGEKPYVCSECGKGLTGKSMLIAHQRTHTGEKPYICNECGKGFTMKSTLSIHQQTHTGEKPYKCNECDKTFRKKTCLIQHQRFHTGKTSFACTECGKFSLRKNDLITHQRIHTGEKPYKCSDCGKAFTTKSGLNVHQRKHTGERPYGCSDCGKAFAHLSILVKHRRIHR

SEQ ID NO: 16300 - protein, 781 aa, Homo Sapiens
MATQGHLTFKDVAIEFSQEEWKCLEPVQKALYKDVMLENYRNLVFLGISPKCVIKELPPTENSNTGERFQTVALERHQSYDIENLYFREIQKHLHDLEFQWKDGETNDKEVPVPHENNLTGKRDQHSQGDVENNHIENQLTSNFESRLAELQKVQTEGRLYECNETEKTGNNGCLVSPHIREKTYVCNECGKAFKASSSLINHQRIHTTEKPYKCNECGKAFHRASLLTVHKVVHTRGKSYQCDVCGKIFRKNSYFVRHQRSHTGQKPYICNECGKSFSKSSHLAVHQRIHTGEKPYKCNLCGKSFSQRVHLRLHQTVHTGERPFKCNECGKTFKRSSNLTVHQVIHAGKKPYKCDVCGKAFRHRSNLVCHRRIHSGEKQYKCNECGKVFSKRSSLAVHRRIHTVEKPCKCNECGKVFSKRSSLAVHQRIHTGQKTYKCNKCGKVYSKHSHLAVHWRIHTGEKAYKCNECGKVFSIHSRLAAHQRIHTGEKPYKCNECGKVFSQHSRLAVHRRIHTGEKPYKCKECGKVFSDRSAFARHRRIHTGEKPYKCKECGKVFSQCSRLTVHRRIHSGEKPYKCNECGKVYSQYSHLVGHRRVHTGEKPYKCHECGKAFNQGSTLNRHQRIHTGEKPYKCNQCGNSFSQRVHLRLHQTVHTGDRPYKCNECGKTFKRSSNLTAHQIIHAGKKPYKCDECGKVFRHSSHLVSHQRIHTGEKRYKCIECGKAFGRLFSLSKHQRIHSGKKPYKCNECGKSFICRSGLTKHRIRHTGESLTTKLNVTRP

SEQ ID NO: 16301 - protein, 954 aa, Homo Sapiens
MNQPGGAAAPQADGASAAGRKSTASRERLKRSQKSTKVEGPEPVPAEASLSAEQGTMTEVKVKTELPDDYIQEVIWQGEAKEEKKAVSKDGTSDVPAEICVVIGGVRNQQTLDGKAPEGSPHGGSVRSRYSGTWIFDQALRYASGSYECGICGKKYKYYNCFQTHVRAHRDTEATSGEGASQSNNFRYTCDICGKKYKYYSCFQEHRDLHAVDVFSVEGAPENRADPFDQGVVATDEVKEEPPEPFQKIGPKTGNYTCEFCGKQYKYYTPYQEHVALHAPISTAPGWEPPDDPDTGSECSHPEVSPSPRFVAAKTQTNQSGKKAPASVVRCATLLHRTPPATQTQTFRTPNSGSPASKATAAESAFSRRVEGKAQNHFEETNSSSQNSSEPYTCGACGIQFQFYNNLLEHMQSHAADNENNIASNQSRSPPAVVEEKWKPQAQRNSANNTTTSGLTPNSMIPEKERQNIAERLLRVMCADLGALSVVSGKEFLKLAQTLVDSGARYGAFSVTEILGNFNTLALKHLPRMYNQVKVKVTCALGSNACLGIGVTCHSQSVGPDSCYILTAYQAEGNHIKSYVLGVKGADIRDSGDLVHHWVQNVLSEFVMSEIRTVYVTDCRVSTSAFSKAGMCLRCSACALNSVVQSVLSKRTLQARSMHEVIELLNVCEDLAGSTGLAKETFGSLEETSPPPCWNSVTDSLLLVHERYEQICEFYSRAKKMNLIQSLNKHLLSNLAAILTPVKQAVIELSNESQPTLQLVLPTYVRLEKLFTAKANDAGTVSKLCHLFLEALKENFKVHPAHKVAMILDPQQKLRPVPPYQHEEIIGKVCELINEVKESWAEEADFEPAAKKPRSAAVENPAAQEDDRLGKNEVYDYLQEPLFQATPDLFQYWSCVTQKHTKLAKLAFWLLAVPAVGARSGCVNMCEQALLIKRRRLLSPEDMNKLMFLKSNML

SEQ ID NO: 16302 - protein, 560 aa, Homo Sapiens
MGQPAPYAEGPIQGGDAGELCKCDFLVSISIPQTRSDIPAGARRSSMGPRSLDTCWGRGPERHVHRLECNGVIFTHRNLCLPGGKTKTENEEKTAQLNISKESESHRLIVEGLLMDVPQHPDFKDRLEKSQLHDTGNKTKIGDCTDLTVQDHESSTTEREEIARKLEESSVSTHLITKQGFAKEQVFYKCGECGSYYNPHSDFHLHQRVHTNEKPYTCKECGKTFRYNSKLSRHQKIHTGEKPYSCEECGQAFSQNSHLLQHQKLHGGQRPYECTDCGKTFSYNSKLIRHQRIHTGEKPFKCKECGKAFSCSYDCIIHERIHNGEKPYECKECGKSLSSNSVLIQHQRIHTGEKPYECKECGKAFHRSSVFLQHQRFHTGEQLYKCNECWKTFSCSSRFIVHQRIHNGEKPYECQECGKTFSQKITLVQHQRVHTGEKPYECKECGKAFRWNASFIQHQKWHTRKKLINGTGLSAVKPYCPCAILSPLPPQHTCSALAPPGPPLSSSHAVVLPPSVPFFLLLPSSEKANPSPVQIAHFFQDLAFPGKSSLQSPNPLSHSL

SEQ ID NO: 16303 - protein, 422 aa, Homo Sapiens
MFQTAWRQEPVTFEDVAVYFTQNEWASLDSVQRALYREVMLENYANVASLAFPFTTPVLVSQLEQGELPWGLDPWEPMGREALRGICPGDEARTEKEGLTPKDHVSKETESFRLMVGGLPGNVSQHLDFGSSLEQPQGHWIIKTKSKRRHFTDTSARHHEAYEVKNGEKFEKLGKNISVSTQLTTNQTNPSGQISYECGQCGRYFIQMADFHRHEKCHTGEKSFECKECGKYFRYNSLLIRHQIIHTGKKPFKCKECGKGLSSDTALIQHQRIHTGEKPYECKECGKAFSSSSVFLQHQRFHTGEKLYECNECWKTFSCSSSFTVHQRMHTGEKPYECKECGKRLSSNTALTQHQRIHTGEKPFECKECGKAFNQKITLIQHQRVHTGEKPYECKVCGKTFSWCGRFILHQKLHTQKTPVQA

SEQ ID NO: 16304 - protein, 439 aa, Homo Sapiens
MLQTTWPQESVTFEDVAVYFTQNQWASLDPAQRALYGEVMLENYANVASLVAFPFPKPALISHLERGEAPWGPDPWDTEILRGISQGGESWIKNEGLVIKQEASEETELHRMPVGGLLRNVSQHFDFKRKALKQTFNLNPNLILRGGMKFYECKECGKIFRYNSKLIRHQMSHTGEKPFKCKECGKAFKSSYDCIVHEKNHIGEGPYECKECGKGLSSNTALTQHQRIHTGEKPYECKECGKAFRRSAAYLQHQRLHTGEKLYKCKECWKAFGCRSLFIVHQRIHTGEKPYQCKECGKAFTQKIASIQHQRVHTGEKPYECKVCGKAFKWYGSFVQHQKLHPVEKKPVKVLGPSLVSPQCSSPAIPPVLLQGSCSASAVAVPSLTFPHAVLIPTSGNFFMLLPTSGIPSSSAQIVRVFQGLTPTVKPSPVILTPSSHSS

SEQ ID NO: 16305 - protein, 477 aa, Homo Sapiens
MATYTCITCRVAFRDADMQRAHYKTDWHRYNLRRKVASMAPVTAEGFQERVRAQRAVAEEESKGSATYCTVCSKKFASFNAYENHLKSRRHVELEKKAVQAVNRKVEMMNEKNLEKGLGVDSVDKDAMNAAIQQAIKAQPSMSPKKAPPAPAKEARNVVAVGTGGRGTHDRDPSEKPPRLQWFEQQAKKLAKQQEEDSEEEEEDLDGDDWEDIDSDEELECEDTEAMDDVVEQDAEEEEAEEGPPLGAIPITDCLFCSHHSSSLMKNVAHMTKDHSFFIPDIEYLSDIKGLIKYLGEKVGVGKICLWCNEKGKSFYSTEAVQAHMNDKSHCKLFTDGDAALEFADFYDFRSSYPDHKEGEDPNKAEELPSEKNLEYDDETMELILPSGARVGHRSLMRYYKQRFGLSRAVAVAKNRKAVGRVLQQYRALGWTGSTGAALMRERDMQYVQRMKSKWMLKTGMKNNATKQMHFRVQVRF

SEQ ID NO: 16306 - protein, 536 aa, Homo Sapiens
MILLSFVSDSNVGTGEKKVTEAWISEDENSHRTTSDRLTVMELPSPESEEVHEPRLGELLGNPEGQSLGSSPSQDRGCKQVTVTHWKIQTGETAQVCTKSGRNHILNSDLLLLQRELIEGEANPCNICGKTFTFNSDLVRHRISHAGEKPYTCDQCGKGFGQSSHLMEHQRIHTGERLYVCNVCGKDFIHYSGLIEHQRVHSGEKPFKCAQCGKAFCHSSDLIRHQRVHTRERPFECKECGKGFSQSSLLIRHQRIHTGERPYECNECGKSFIRSSSLIRHYQIHTEVKQYECKECGKAFRHRSDLIEHQRIHTGERPFECNECGKAFIRSSKLIQHQRIHTGERPYVCNECGKRFSQTSNFTQHQRIHTGEKLYECNECGKAFFLSSYLIRHQKIHTGERVYECKECGKAFLQKAHLTEHQKIHSGDRPFECKDCGKAFIQSSKLLLHQIIHTGEKPYVCSYCGKGFIQRSNFLQHQKIHTEEKLYECSQYGRDFNSTTNVKNNQRVHQEGLSLSKAPIHLGERSVDKGEHTGNL

SEQ ID NO: 16307 - protein, 865 aa, Homo Sapiens
MSLQDSTLSREGKPEGEIMAAVFFSVGRLSPEVTQPDEDLHLQAEETQLVKESVTFKDVAIDFTLEEWRLMDPTQRNLHKDVMLENYRNLVSLGLAVSKPDMISHLENGKGPWVTVREISRIPYPDMEPKPATKKATRTKAISEDLSQEAILEKLTENGLWDSRMEGLWKWNDRILRLQNNQENHLSQRIIPLKKTPTSQRGFRFESILIPEPGIATEELHSRCQTQEENFTENLNLITDTHLGKIICKEMKGSKAIRQTSELTLGKKSNNKEKPYKCSTCEKAFHYRSLLIQHQRTHTKEKPYECNECGKTFSQPSYLSQHKKIHTGEKPYKCNECGKAFIASSSLMVHQRIHTKEKPYQCNVCGKSFSQCARLNQHQRIQTGEKPYKCSECGKAFSDKSKLARHQETHNGEKPYKCDDCGKAFRNKSYLSVHQKTHTEEKPYQCNECGKSFKNTTIFNVHQRIHTGEKPFRCNECGKAYRSNSSLIVHIRTHTGEKPYECNECGKAFNRIANFTEHQRIHTGEKPYKCNECGKAFINYSCLTVHHRMHTGEKPYKCTECGKAFMRSSSLIIHQRIHTEEKPYLCNECGESFRIKSHLTVHQRIHTGEKPYKCTDCERAFTKMVNLKEHQKIHTGVKPYKCYDCGKSFRTKSYLIVHQRTHTGEKPYKCNECEKAFTNTSQLTVHQRRHTGEKPYKCNECGKVFTSNSGFNTHQRTHTGEKPFKCNDCGKAFSQMVHVTEHQKIHSGEKPYKCDVCGKAFRRGSYLTVHWRTHTGEKPYTCKECGKGCITLSQLTLHQRIHTGERPYKCEECGKAFRTNSDFTVHLRMHTGEKPYKCNECGKAFRSSSSLTVHQRIHQRETQLI

SEQ ID NO: 16308 - protein, 306 aa, Homo Sapiens
MGERLLESKKDHQHGEILTQVPDDMLKKKTPRVKSCGEVSVGHASLNRHHRADTGHKPYEYQEYGQKPYKCTYCKKAFSDLPYFRTHEWAHTGGKPYDCEECGKSFISRSSIRRHRIMHSGDGPYKCNFCGKALMCLSLYLIHKRTHTGEKPYECKQCGKAFSHSGSLRIHERTHTGEKPYECSECGKAFHSSTCLHAHKITHTGEKPYECKQCGKAFVSFNSVRYHERTHTGEKPYECKQCGKAFRSASHLRTHGRTHTGEKPYECKQCGKAFGCASSVKIHERTHTGEKPCSSNTSKGQGEKIA

SEQ ID NO: 16309 - protein, 528 aa, Homo Sapiens
MGPLQFRDVAIEFSLEEWHCLDTAQRNLYRNVMLENYSNLVFLGITVSKPDLITCLEQGRKPLTMKRNEMIAKPSVMCSHFAQDLWPEQSMKDSFQKVVLRRYEKCEHDNLQLKKGCISVDECKVHKEGYNELNQCLTTTPRKICQCDKYVKVLHQFPNSNGQKRGHTGKKPFKYIECGKAFKQFSTLTTHKKIHTGGKPYKCEECGKAFNHSCSLTRHKKIHTGEKPYKCEECGKAFKHSSTLTTHKRNHTGEKPYKCDKCGKAFMSSSTLSKHEIIHTEKKPYKCEECGKAFNRSSTLTTHKIIHTGEKPYKCEECDKAFKYSYTLTTHKRIHTEDKPYKCEECGKAFKYSSTLTTHKRIHTGEKPYKCEECGKAFKRSSDLTTHKIIHTGEKPYKCEECGKAFKYSSNLTTHKKIHTGERPYKCEECGKAFNQSSILTTHRRIHTGEKFYKCEECGKAFKCSSNLTTHKKIHTGERPYKCEECGKAFNQSSILTTHERIILERNSTNVKNVAKPSSGPHTLLHIR

SEQ ID NO: 16310 - protein, 461 aa, Homo Sapiens
MDSVAFEDVAVNFTLEEWALLDPSQKNLYRDVMRETFRNLASVGKQWEDQNIEDPFKIPRRNISHIPERLCESKEGGQGEETFSQIPDGILNKKTPGVKPCESSVCGEVGMGPSSLNRHIRDHTGREPNEYQEYGKKSYTRNQCGRALSYHRSFPVRERTHPGGKPYDCKECGETFISLVSIRRHMLTHRGGVPYKCKVCGKAFDYPSLFRIHERSHTGEKPYECKQCGKAFSCSSYIRIHERTHTGDKPYECKQCGKAFSCSKYIRIHERTHTGEKPYECKQCGKAFRCASSVRSHERTHTGEKLFECKECGKALTCLASVRRHMIKHTGNGPYKCKVCGKAFDFPSSFRIHERTHTGEKPYDCKQCGKAFSCSSSFRKHERIHTGEKPYKCTKCGKAFSRSSYFRIHERTHTGEKPYECKQCGKAFSRSTYFRVHEKIHTGEKPYENPNPNASVVPVLS

SEQ ID NO: 16311 - protein, 1059 aa, Homo Sapiens
MSGVMVGSHADMAPASTAEGAGEKPGPAAPAPAAQYECGECGKSFRWSSRLLHHQRTHTGERPYKCPDCPKAFKGSSALLYHQRGHTGERPYQCPDCPKAFKRSSLLQIHRSVHTGLRAFICGQCGLAFKWSSHYQYHLRQHTGERPYPCPDCPKAFKNSSSLRRHRHVHTGERPYTCGVCGKSFTQSTNLRQHQRVHTGERPFRCPLCPKTFTHSSNLLLHQRTHGAAPAPGTASAAPPPQSREPGKVFVCDAYLQRHLQPHSPPAPPAPPPPPPPVVPELFLAAAETTVELVYRCDGCEQGFSSEELLLEHQPCPGPDAAPQPQEAPAEAPKADQPPSPLPQPPPPAAAPAPGFACLPCGKSFRTVAGLSRHQHSHGAAGGQAFRCGSCDGSFPQLASLLAHQQCHVEEAAAGRPPPQAEAAEVTCPQEPLAPAAPVPPPPPSAPASAERPYKCAECGKSFKGSSGLRYHLRDHTGERPYQCGECGKAFKRSSLLAIHQRVHTGLRAFTCGQCGLTFKWSSHYQYHLRLHSGERPYACGECGKAFRNTSCLRRHRHVHTGERPHACGVCGKSFAQTSNLRQHQRVHTGERPFRCPLCPKTFTHSSNLLLHQRTHSAERPFTCPICGRGFVMAAYLQRHLRTHAPANTPPSTTAPAAGPQPPAPLAAARAPPATQDVHVLPHLQATLSLEVAGGTAQAPSLGPAAPNSQTFLLVQTAQGLQLIPSSVQPPTPPPPPAPPKLILLPSSSAGAGGGRARQGPRAVGKAGQGAGVVWLPGPGGLGVQGAASAGASGTGQSLIVLQNVGGGEAGPQEMSGVQLQPLRPAPEVTTVQLQPAQEVTTVQLQPAQEVTTVQLQPAQEVTTVQLQPVAGQLSNSSGGAVATEAPNLLVVQSGAAEELLTGPGPGEAGDGEASTGVVQDVLFETLQTDEGLQSVLVLSGADGEQTRLCVQEVETLPPGLTEPPATGPPGQKLLIIRSAPATELLDSSNTGGGTATLQLLAPPPSGPASGPAGLPGAPASQMVQVVPAGAGPGVMTPQGLPSIQIVQTLPAVQLVHTF

SEQ ID NO: 16312 - protein, 869 aa, Homo Sapiens
MEPETALWGPDLQGPEQSPNDAHRGAESENEEESPRQESSGEEIIMGDPAQSPESKDSTEMSLERSSQDPSVPQNPPTPLGHSNPLDHQIPLDPPAPEVVPTPSDWTKACEASWQWGALTTWNSPPVVPANEPSLRELVQGRPAGAEKPYICNECGKSFSQWSKLLRHQRIHTGERPNTCSECGKSFTQSSHLVQHQRTHTGEKPYKCPDCGKCFSWSSNLVQHQRTHTGEKPYKCTECEKAFTQSTNLIKHQRSHTGEKPYKCGECRRAFYRSSDLIQHQATHTGEKPYKCPECGKRFGQNHNLLKHQKIHAGEKPYRCTECGKSFIQSSELTQHQRTHTGEKPYECLECGKSFGHSSTLIKHQRTHLREDPFKCPVCGKTFTLSATLLRHQRTHTGERPYKCPECGKSFSVSSNLINHQRIHRGERPYICADCGKSFIMSSTLIRHQRIHTGEKPYKCSDCGKSFIRSSHLIQHRRTHTGEKPYKCPECGKSFSQSSNLITHVRTHMDENLFVCSDCGKAFLEAHELEQHRVIHERGKTPARRAQGDSLLGLGDPSLLTPPPGAKPHKCLVCGKGFNDEGIFMQHQRIHIGENPYKNADGLIAHAAPKPPQLRSPRLPFRGNSYPGAAEGRAEAPGQPLKPPEGQEGFSQRRGLLSSKTYICSHCGESFLDRSVLLQHQLTHGNEKPFLFPDYRIGLGEGAGPSPFLSGKPFKCPECKQSFGLSSELLLHQKVHAGGKSSQKSPELGKSSSVLLEHLRSPLGARPYRCSDCRASFLDRVALTRHQETHTQEKPPNPEDPPPEAVTLSTDQEGEGETPTPTESSSHGEGQNPKTLVEEKPYLCPECGAGFTEVAALLLHRSCHPGVSL

SEQ ID NO: 16313 - protein, 485 aa, Homo Sapiens
MNEYPKKRKRKTLHPSRYSDSSGISRIADGFNGIFSDHCYSVCSMRQPDLKYFDNKDDDSDTETSNDLPKFADGIKARNRNQNYLVPSPVLRILDHTAFSTEKSADIVICDEECDSPESVNQQTQEESPIEVHTAEDVPIAVEVHAISEDYDIETENNSSESLQDQTDEEPPAKLCKILDKSQALNVTAQQKWPLLRANSSGLYKCELCEFNSKYFSDLKQHMILKHKRTDSNVCRVCKESFSTNMLLIEHAKLHEEDPYICKYCDYKTVIFENLSQHIADTHFSDHLYWCEQCDVQFSSSSELYLHFQEHSCDEQYLCQFCEHETNDPEDLHSHVVNEHACKLIELSDKYNNGEHGQYSLLSKITFDKCKNFFVCQVCGFRSRLHTNVNRHVAIEHTKIFPHVCDDCGKGFSSMLEYCKHLNSHLSEGIYLCQYCEYSTGQIEDLKIHLDFKHSADLPHKCSDCLMRFGNERELISHLPVHETT

SEQ ID NO: 16314 - protein, 438 aa, Homo Sapiens
MQAEDRSQFGSAAEMLSEQTAALGTGWESMNVQLDGAEPQVERGSQEERPWRTVPGPLEHLCCDLEEEPQSLQEKAQSAPWVPAIPQEGNTGDWEMAAALLAAGSQGLVTIKDVSLCFSQEEWRSLDPSQTDFYGEYVMQENCGIVVSLRFPIPKLDMLSQLEGGEEQWVPDPQDLEERDILRVTYTGDGSEHEGDTPELEAEPPRMLSSVSEDTVLWNPEHDESWDSMPSSSRGMLLGPPFLQEDSFSNLLCSTEMDSLLRPHTCPQCGKQFVWGSHLARHQQTHTGERPYSCLKCEKTFGRRHHLIRHQKTHLHDKTSRCSECGKNFRCNSHLASHQRVHAEGKSCKGQEVGESPGTRKRQRAPPVPKCHVCTECGKSFGRRHHLVRHWLTHTGEKPFQCPRCEKSFGRKHHLDRHLLTHQGQSPRNSWDRGTSVF

SEQ ID NO: 16315 - protein, 1327 aa, Homo Sapiens
MRSFLQQDVNKTKSRLNVLNGLANNMDDLKINTDITGAKEELLDDNNFISDKESGVHKPKDCQTSFQKNNTLTLPEELSKDKSENALSGGQSSLFIHAGAPTVSSENFILPKGAAVNGPVSHSSLTKTSNMNKGSVSLTTGQPVDQPTTESCSTLKVAADLQLSTPQKASQHQVLFLLSDVAHAKNPTHSNKKLPTSASVGCDIQNSVGSNIKSDGTLINQVEVGEDGEDLLVKDDCVNTVTGISSGTDGFRSENDTNWDPQKEFIQFLMTNEETVDKAPPHSKIGLEKKRKRKMDVSKITRYTEDCFSDSNCVPNKSKMQEVDFLEQNEELQAVDSQKYALSKVKPESTDEDLESVDAFQHLIYNPDKCGEESSPVHTSTFLSNTLKKKCEESDSESPATFSTEEPSFYPCTKCNVNFREKKHLHRHMMYHLDGNSHFRHLNVPRPYACRECGRTFRDRNSLLKHMIIHQERRQKLMEEIRELKELQDEGRSARLQCPQCVFGTNCPKTFVQHAKTHEKDKRYYCCEECNFMAVTENELECHRGIAHGAVVKCPMVTSDIAQRKTQKKTFMKDSVVGSSKKSATYICKMCPFTTSAKSVLKKHTEYLHSSSCVDSFGSPLGLDKRKNDILEEPVDSDSTKTLTKQQSTTFPKNSALKQDVKRTFGSTSQSSSFSKIHKRPHRIQKARKSIAQSGVNMCNQNSSPHKNVTIKSSVDQKPKYFHQAAKEKSNAKANSHYLYRHKYENYRMIKKSGESYPVHFKKEEASSLNSLHLFSSSSNSHNNFISDPHKPDAKRPESFKDHRRVAVKRVIKESKKESSVGGEDLDSYPDFLHKMTVVVLQKLNSAEKKDSYETEDESSWDNVELGDYTTQAIEDETYSDINQEHVNLFPLFKSKVEGQEPGENATLSYDQNDGFYFEYYEDTGSNNFLHEIHDPQHLETADASLSKHSSVFHWTDLSLEKKSCPYCPATFETGVGLSNHVRGHLHRAGLSYEARHVVSPEQIATSDKMQHFKRTGTGTPVKRVRKAIEKSETTSEHTCQLCGGWFDTKIGLSNHVRGHLKRLGKTKWDAHKSPICVLNEMMQNEEKYEKILKALNSRRIIPRPFVAQKLASSDDFISQNVIPLEAYRNGLKTEALSVSASEEEGLNFLNEYDETKPELPSGKKNQSLTLIELLKNKRMGEERNSAISPQKIHNQTARKRFVQKCVLPLNEDSPLMYQPQKMDLTMHSALDCKQKKSRSRSGSKKKMLTLPHGADEVYILRCRFCGLVFRGPLSVQEDWIKHLQRHIVNANLPRTGAGMVEVTSLLKKPASITETSFSLLMAEAAS

SEQ ID NO: 16316 - protein, 425 aa, Homo Sapiens
MNKMPAGEQECEYNKEGKYYSKGVKLVRKKKKIPGYRWGDIKINIIGEKDDLPIHFCDKCDLPIKIYGRIIPCKHAFCYHCANLYDKVGYKVCPRCRYPVLRIEAHKRGSVFMCSIVQQCKRTYLSQKSLQAHIKRRHKRARKQVTSASLEKVRPHIAPPQTEISDIPKRLQDRDHLSYIPPEQHTMVSLPSVQHMLQEQHNQPHKDIQAPPPELSLSLPFPIQWETVSIFTRKHGNLTVDHIQNNSDSGAKKPTPPDYYPECQSQPAVSSPHHIIPQKQHYAPPPSPSSPVNHQMPYPPQDVVTPNSVRSQVPALTTTYDPSSGYIIVKVPPDMNSPPLRAPQSQNGNPSASEFASHHYNLNILPQFTENQETLSPQFTQTDAMDHRRWPAWKRLSPCPPTRSPPPSTLHGRSHHSHQRRHRRY

SEQ ID NO: 16317 - protein, 1829 aa, Homo Sapiens
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYKCSQCGKTYKHAGSLTNHRQSHTLGIYPCAICFKEFSNLMALKNHSRLHAQYRPYHCPHCPRVFRLPRELLEHQQSHEGERQEPRWEEKGMPTTNGHTDESSQDQLPSAQMLNGSAELSTSGELEDSGLEEYRPFRCGDCGRTYRHAGSLINHRKSHQTGVYPCSLCSKQLFNAAALKNHVRAHHRPRQGVGENGQPSVPPAPLLLAETTHKEEEDPTTTLDHRPYKCSECGRAYRHRGSLVNHRHSHRTGEYQCSLCPRKYPNLMALRNHVRVHCKAARRSADIGAEGAPSHLKVELPPDPVEAEAAPHTDQDHVCKHEEEATDITPAADKTAAHICSICGLLFEDAESLERHGLTHGAGEKENSRTETTMSPPRAFACRDCGKSYRHSGSLINHRQTHQTGDFSCGACAKHFHTMAAMKNHLRRHSRRRSRRHRKRAGGASGGREAKLLAAESWTRELEDNEGLESPQDPSGESPHGAEGNLESDGDCLQAESEGDKCGLERDETHFQGDKESGGTGEGLERKDASLLDNLDIPGEEGGGTHFCDSLTGVDEDQKPATGQPNSSSHSANAVTGWQAGAAHTCSDCGHSFPHATGLLSHRPCHPPGIYQCSLCPKEFDSLPALRSHFQNHRPGEATSAQPFLCCLCGMIFPGRAGYRLHRRQAHSSSGMTEGSEEEGEEEGVAEAAPARSPPLQLSEAELLNQLQREVEALDSAGYGHICGCCGQTYDDLGSLERHHQSQSSGTTADKAPSPLGVAGDAMEMVVDSVLEDIVNSVSGEGGDAKSQEGAGTPLGDSLCIQGGESLLEAQPRPFRCNQCGKTYRHGGSLVNHRKIHQTGDFLCPVCSRCYPNLAAYRNHLRNHPRCKGSEPQVGPIPEAAGSSELQVGPIPEGGSNKPQHMAEEGPGQAEVEKLQEELKVEPLEEVARVKEEVWEETTVKGEEIEPRLETAEKGCQTEASSERPFSCEVCGRSYKHAGSLINHRQSHQTGHFGCQACSKGFSNLMSLKNHRRIHADPRRFRCSECGKAFRLRKQLASHQRVHMERRGGGGTRKATREDRPFRCGQCGRTYRHAGSLLNHRRSHETGQYSCPTCPKTYSNRMALKDHQRLHSENRRRRAGRSRRTAVRCALCGRSFPGRGSLERHLREHEETEREPANGQGGLDGTAASEANLTGSQGLETQLGGAEPVPHLEDGVPRPGERSQSPIRAASSEAPEPLSWGAGKAGGWPVGGGLGNHSGGWVPQFLTRSEEPEDSVHRSPCHAGDCQLNGPTLSHMDSWDNRDNSSQLQPGSHSSCSQCGKTYCQSGSLLNHNTNKTDRHYCLLCSKEFLNPVATKSHSHNHIDAQTFACPDCGKAFESHQELASHLQAHARGHSQVPAQMEEARDPKAGTGEDQVVLPGQGKAQEAPSETPRGPGESVERARGGQAVTSMAAEDKERPFRCTQCGRSYRHAGSLLNHQKAHTTGLYPCSLCPKLLPNLLSLKNHSRTHTDPKRHCCSICGKAFRTAARLEGHGRVHAPREGPFTCPHCPRHFRRRISFVQHQQQHQEEWTVAGSGRGHEGSQEEVGTQWRGKSSPKVGGGARSERREPRGF

SEQ ID NO: 16318 - protein, 568 aa, Homo Sapiens
MAQVDSQDRWGEASPLSSLTEEAHDTQMLSMNLESDDEDGGEAEKEGTADPVACPRGSSPVTHENPDLPWPHPLGKEEEKFSDSSSAGGMGQKPVEMSGKASWSRDVTKINETQGSPGASRALGSLPSGLAHKLLGQMQPLGDRLPAGDDGYSGANQDAVLDVPPSFPSNGKYLCAHKSVDTSAGNSSLLCFPRPGSNWDLPTQETHTPAQASATPASLAAAVLAKARNSRKVQNQAGRREGGEAEARPYRCLRGGRAFQKPSKPLSPAETRGGAAKRYACELCGKAYSHRGTLQQHRRLHTGERPYQCSFCDKAYTWSSDHRKHIRTHTGEKPYPCPDCGKAFVRSSDLRKHQRNMHSNNKPFPCSECGLTFNKPLSLLRHQRTHLGAKPFRCPACDREFAVASRMVEHQRVHSGERPFPCPTCGKCFTKSSNLSEHQTLHTGQRPFKCADCGVAFAQPSRLVRHQRIHTGERPFPCTQCGQAFARSSTLKRHQQIHSGEKGFLCAECGRAFRIASELAQHIRMHNGERPYQCEDCGQAFTRSNHLQRHRAKHGTCKKEPIPSSSDE

SEQ ID NO: 16319 - protein, 505 aa, Homo Sapiens
MTKAQESLTLEDVAVDFTWEEWQFLSPAQKDLYRDVMLENYSNLVSVGYQAGKPDALTKLEQGEPLWTLEDEIHSPAHPEIEKADDHLQQPLQNQKILKRTGQRYEHGRTLKSYLGLTNQSRRYNRKEPAEFNGDGAFLHDNHEQMPTEIEFPESRKPISTKSQFLKHQQTHNIEKAHECTDCGKAFLKKSQLTEHKRIHTGKKPHVCSLCGKAFYKKYRLTEHERAHRGEKPHGCSLCGKAFYKRYRLTEHERAHKGEKPYGCSECGKAFPRKSELTEHQRIHTGIKPHQCSECGRAFSRKSLLVVHQRTHTGEKPHTCSECGKGFIQKGNLNIHQRTHTGEKPYGCIDCGKAFSQKSCLVAHQRYHTGKTPFVCPECGQPCSQKSGLIRHQKIHSGEKPYKCSDCGKAFLTKTMLIVHHRTHTGERPYGCDECEKAYFYMSCLVKHKRIHSREKRGDSVKVENPSTASHSLSPSEHVQGKSPVNMVTVAMVAGQCEFAHILHS

SEQ ID NO: 16320 - protein, 606 aa, Homo Sapiens
MSHTASSCQELVENCAVHVAGMAQEDSRRGQVPSSFYHGANQELDLSTKVYKRESGSPYSVLVDTKMSKPHLHETEEQPYFRETRAVSDVHAVKEDRENSDDTEEEEEEVSYKREQIIVEVNLNNQTLNVSKGEKGVSSQSKETPVLKTSSEEEEEESEEEATDDSNDYGENEKQKKKEKIVEKVSVTQRRTRRAASVAAATTSPTPRTTRGRRKSVEPPKRKKRATKEPKAPVQKAKCEEKETLTCEKCPRVFNTRWYLEKHMNVTHRRMQICDKCGKKFVLESELSLHQQTDCEKNIQCVSCNKSFKKLWSLHEHIKIVHGYAEKKFSCEICEKKFYTMAHVRKHMVAHTKDMPFTCETCGKSFKRSMSLKVHSLQHSGEKPFRCENCDERFQYKYQLRSHMSIHIGHKQFMCQWCGKDFNMKQYFDEHMKTHTGEKPFICEICGKSFTSRPNMKRHRRTHTGEKPYPCDVCGQRFRFSNMLKAHKEKCFRVTSPVNVPPAVQIPLTTSPATPVPSVVNTATTPTPPINMNPVSTLPPRPIPHPFSHLHIHPHPHHPHHLPIPPVPHLPPPPALFKSEPLNHRGQSEDNFLRHLAEKNSSAQHH

SEQ ID NO: 16321 - protein, 615 aa, Homo Sapiens
MAERALEPEAEAEAEAGAGGEAAAEEGAAGRKARGRPRLTESDRARRRLESRKKYDVRRVYLGEAHGPWVDLRRRSGWSDAKLAAYLISLERGQRSGRHGKPWEQVPKKPKRKKRRRRNVNCLKNVVIWYEDHKHRCPYEPHLAELDPTFGLYTTAVWQCEAGHRYFQDLHSPLKPLSDSDPDSDKVGNGLVAGSSDSSSSGSASDSEESPEGQPVKAAAAAAAATPTSPVGSSGLITQEGVHIPFDVHHVESLAEQGTPLCSNPAGNGPEALETVVCVPVPVQVGAGPSALFENVPQEALGEVVASCPMPGMVPGSQVIIIAGPGYDALTAEGIHLNMAAGSGVPGSGLGEEVPCAMMEGVAAYTQTEPEGSQPSTMDATAVAGIETKKEKEDLCLLKKEEKEEPVAPELATTVPESAEPEAEADGEELDGSDMSAIIYEIPKEPEKRRRSKRSRVMDADGLLEMFHCPYEGCSQVYVALSSFQNHVNLVHRKGKTKVCPHPGCGKKFYLSNHLRRHMIIHSGVREFTCETCGKSFKRKNHLEVHRRTHTGETPLQCEICGYQCRQRASLNWHMKKHTAEVQYNFTCDRCGKRFEKLDSVKFHTLKSHPDHKPT

SEQ ID NO: 16322 - protein, 581 aa, Homo Sapiens
MLCNKEFLGGHIVRHAQAHQKKGSFACVICGRKFRNRGLMQKHLKNHVKKIQRQQIAAAQQDDQEVTALEEINCSSSSISFENGNSDSKDLEVETLTASSEGNKEVIPEHVAEFIEIPISVPEDVIENVIENGSPNNSLNNVFKPLTECGDDYEEEEDEEGDYEEDDYDLNQETSVIHKINGTVCHPKDIYATDQEGNFKCPALGCVRIFKRIGFLNKHAMTVHPTDLNVRQTVMKWSKGKCKFCQRQFEDSQHFIDHLNRHSYPNVYFCLHFNCNESFKLPFQLAQHTKSHRIFQAQCSFPECHELFEDLPLLYEHEAQHYLSKTPESSAQPSETILWDVQTDSNPNQEKDSSSNEKQTISLPVSTSKSRKESTEPKTCIESMEKKTDSLVQNGNERSDDTVSNISLIDQKMPDIEPNSENNCSSSDIVNGHSEIEQTPLVSSDPALKIDTNRIRTENGSILPSVVPQEHNTLPVSQAPSKPNLTSEHTSYGLILTKPYVRPLPPSYLDERYLSMPKRRKFLTDRVDACSDQDNVYKKSVKRLRCGKCLTTYCNAEALEAHLAQKKCQTLFGFDSDDESA

SEQ ID NO: 16323 - protein, 491 aa, Homo Sapiens
MEEIPAQEAAGSPRVQFQSLETQSECLSPEPQFVQDTDMEQGLTGDGETREENKLLIPKQKISEEVHSYKVRVGRLKHDITQVPETREVYKSEDRLERLQEILRKFLYLEREFRQITISKETFTSEKNNECHEPEKSFSLDSTIDADQRVLRIQNTDDNDKYDMSFNQNSASGKHEHLNLTEDFQSSECKESLMDLSHLNKWESIPNTEKSYKCDVCGKIFHQSSALTRHQRIHTREKPYKCKECEKSFSQSSSLSRHKRIHTREKPYKCEASDKSCEASDKSCSPSSGIIQHKKIHTRAKSYKCSSCERVFSRSVHLTQHQKIHKEMPCKCTVCGSDFCHTSYLLEHQRVHHEEKAYEYDEYGLAYIKQQGIHFREKPYTCSECGKDFRLNSHLIQHQRIHTGEKAHECNECGKAFSQTSCLIQHHKMHRKEKSYECNEYEGSFSHSSDLILQQEVLTRQKAFDCDVWEKNSSQRAHLVQHQSIHTKENS

SEQ ID NO: 16324 - protein, 1059 aa, Homo Sapiens
MNMSQASVSFQDVTVEFTREEWQHLGPVERTLYRDVMLENYSHLISVGYCITKPKVISKLEKGEEPWSLEDEFLNQRYPGYFKVDHIKGIREKQEKPLWQEIFISDADKTLSKEGQKVLEKPFNLEIAPELSEKISCKCDSHRMNLPVASQLIISERKYSRKKTEYMNVCEKLQLDIKHEKAHAEEKSYEHGENAKAFSYKKDQHWKFQTLEESFECDGSGQGLYDKTICITPQSFLTGEKSCKDDEFRKNFDKITLFNHMRTDTRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTEDKFYLSDEHGKCRKSFYRKAHLIQHQRPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHTGEKPYECSDCEKTFAHNSALRAHHRIHTGEKPYECNECGRSFAHISVLKAHQRIHTGEKPYECNECGRSFTYNSALRAHQRIHTGRKPYECSDCEKTFAHNSALKIHQRIHTGEKPYECNECEKTFAHNSALRAHQNIHTGEKLYECSECGKTFFQKTRLSTHRRIHTGEKPYECSKCGKTFSQKSYLSGHERIHTGEKPYECNVCGKTFVYKAALIVHQRIHTGEKPYECNQCGKTFSQRTHLCAHQRIHTGEKPYECNECGKTFADNSALRAHHRIHTGEKPYECNDCGKTFSKTSHLRAHLRTRSGEKPYECSECGKTFSEKSYVSAHQRVHTGEKPYECNVCGKPFAHNSTLRVHQRIHTGEKSYECNDCGKTFSQKSHLSAHQRIHTGEKPYECNECGKAFAQNSTLRVHQRIHTGEKPYECDECGKTFVRKAALRVHHTRMHTREKTLACNGFGKS

SEQ ID NO: 16325 - protein, 819 aa, Homo Sapiens
MMNLEKNFDKTTLFNHMRTDKRGKCSDLNEYGTSCDKTTAVEYNKVHMAMTHYECNERGINFSRKSPLTQSQRTITGWSAFESNKCEENFSQSSAHIVHQKTQAGDKFGEHNECTDALYQKLDFTAHQRIHTDFTAHQKFYLSDEHGKCRKSFYWKAHLIQHERPHSGEKTYQYEECAKSFCSSSHPIQHPGTYVGFKLYECNECGKAFCQNSNLSKHLRIHTKEKPCDNNGCGRSYKSPLIGHQKTDAEMELCGGSEYGKTSHLKGHQRILMGEKPYECIECGKTFSKTSHLRAHQRIHTGEKPYECVECEKTFSHKTHLSVHQRVHTGEKPYECNDCGKSFTYNSALRAHQRIHTGEKPYECSDCEKTFAHNSALRAHHRIHTGEKPYECNECGRSFAHISVLKAHQRIHTREKPYECNECGRSFTYNSALRAHQRIHTGRKPYECSDCEKTFAHNSALKIHQRIHTGEKPYKCNECEKTFAHNSALRAHQNIHTGEKLYECSECGKTFFQKTRLSTHRRIHTGEKPYECSKCGKTFSQKSYLSGHERIHTGEKPYECNVCGKTFVYKAALIVHQRIHTGEKPYECNECGKTFSQRTHLCAHQRIHTGEKPYECNECGKTFADNSALRAHHRIHTGEKPYECNDCGKTFSKTSHLRAHLRTRSGEKPYECSECGKTFSEKSYVSAHQRVHTGEKPYECNVCGKPFAHNSTLRVHQRIHTGEKSYECNDCGKTFSQKSHLSAHQRIHTGEKPYECNECGKAFAQNSTLRVHQRIHTGEKPYECDECGKTFVRKAALRVHHTRMHTREKTLACNGFGKS

SEQ ID NO: 16326 - protein, 573 aa, Homo Sapiens
MGPLQFRDVAIEFSLEEWHCLDMAQRNLYRDVMLENYRNLVFLGIVVSKPDLITHLEQGKKPSTMQRHEMVANPSVLCSHFNQDLWPEQSIKDSFQKLILRRHKKCGHDNLQLKKGCESVDKCKVHKRGYNGLNQCLTTTQSKMFQCDKHGKVFHQFSNTNRHKIRHTGKNPCKFTECGKAFNRSSTFTTHKKIHTGEKPYKCIECGKAFNRSSHLTTHKIIHTGEKRYKCEDCGKAFNRSSNLTTHKKIHTGEKPYKCEECGKAFKRSSILTTHKRIHTGEKPYKCEECGKVFKYLSSLSTHKIIHTGEKPYKCEECGKAFNWSSHLTTHKRIHTGEKPYKCEECGKGFKYSSTLTKHKIIHTGEKPYKCEECGEAFKYSCSLTAHKIIHTGKKPYKCEECGKVFKHSSPLSKHKRIHTGEKPYKCEECGKAFSRSSILTTHKIIHTGEKPYECEDCGKAFNRSSNLTKHKKIHTGEKPYKCEECGKAFKCSSILTTHKRIHTADKPYKCEECGKDFKYSSTLTRHKKIHTGGKPHKCNKCGKAFISSSNLSRHEIIHMGGNPYKCENVAKP

SEQ ID NO: 16327 - protein, 331 aa, Homo Sapiens
MRRKTRNFKHKTVKDNKVLTEGSDQESEKDNSQCCDPATNERVQAEKRQYVCTECGKAFSQSANLTVHERIHTGEKPYKCKECGKAFSHSSNLVVHRRIHTGLKPYTCSECGKSFSGKSHLIRHQGIHSGEKTYECKECGKAFSRSSGLISHHRVHTGEKPYSCIECGKAFSRSSNLTQHQRMHRGKKVYKCKECGKTCGSNTKIMDHQRIHTGEKPYECDECGKTFILRKTLNEHQRLHRREKPYKCNECGKAFTSNRNLVDHQRVHTGEKPYKCNECGKTFRQTSQVILHLRTHTKEKPYKCSECGKAYRYSSQLIQHQRKHNEEKETS

SEQ ID NO: 16328 - protein, 426 aa, Homo Sapiens
MLENYGAVASLAAFPFPKPALISQLERGETPWCSVPRGALDGEAPRGISSGYPFLKPAGISHPEQVEEPLNLKLQGEGPSLICPEGVLKRKKEDFILKEEIIEEAQDLMVLSSGPQWCGSQELWFGKTCEEKSRLGRWPGYLNGGRMESSTNDIIEVIVKDEMISVEESSGNTDVNNLLGIHHKILNEQIFYICEECGKCFDQNEDFDQHQKTHNGEKVYGCKECGKAFSFRSHCIAHQRIHSGVKPYECQECAKAFVWKSNLIRHQRIHTGEKPFECKECGKGFSQNTSLTQHQRIHTGEKPYTCKECGKSFTRNPALLRHQRMHTGEKPYECKDCGKGFMWNSDLSQHQRVHTGDKPHECTDCGKSFFCKAHLIRHQRIHTGERPYKCNDCGKAFSQNSVLIKHQRRHARDKPYNCQISHLLEH

SEQ ID NO: 16329 - protein, 261 aa, Homo Sapiens
MIYKCPMCREFFSERADLFMHQKIHTAEKPHKCDKCDKGFFHISELHIHWRDHTGEKVYKCDDCGKDFSTTTKLNRHKKIHTVEKPYKCYECGKAFNWSSHLQIHMRVHTGEKPYVCSECGRGFSNSSNLCMHQRVHTGEKPFKCEECGKAFRHTSSLCMHQRVHTGEKPYKCYECGKAFSQSSSLCIHQRVHTGEKPYRCCGCGKAFSQSSSLCIHQRVHTGEKPFKCDECGKAFSQSTSLCIHQRVHTKERNHLKISVI

SEQ ID NO: 16330 - protein, 613 aa, Homo Sapiens
MGEAFYTVKLERLESCDTVGLSFQEVQKNTYDFECQWKDDEGNYKTVLMLQKENLPGRRAQRDRRAAGNRHIENQLGVSFQSHLPELQQFQHEGKIYEYNQVEKSPNNRGKHYKCDECGKVFSQNSRLTSHKRIHTGEKPYQCNKCGKAFTVRSNLTIHQVIHTGEKPYKCNECGKVFSQPSNLAGHQRIHTGEKPYKCNECGKAFRAHSKLTTHQVIHTGEKPYKCKECGKCFTQNSHLASHRRIHTGEKPYKCNECGKAFSVRSSLTTHQTIHTGEKPYKCNECGKVFRHNSYLAKHRRIHTGEKPYKCNECGKAFSMHSNLTKHQIIHTGEKPFKCNECVKVFTQYSHLANHRRIHTGEKPYRCDECGKAFSVRSSLTTHQAIHTGEKPYKCNDCGKVFTQNSHLASHRGIHSGEKPYKCDECGKAFSQTSQLARHWRVHTGEKPYKCNECGKAFSVHSSLTIHQTIHTGQKPYKCNDCGKVFRHNSYLAIHQRIHTGEKPYKCNECGKAFSVHSNLATHQVIHTGEKPYKCNECGKVFTQNSHLANHRRIHTGEKPYRCNECGKAFSVRSTLTTHMAVHTGDKPYKCNQCGKVFTQNSNLAKHRRIHSG

SEQ ID NO: 16331 - protein, 610 aa, Homo Sapiens
MPSARGKSKSKAPITFGDLAIYFSQEEWEWLSPIQKDLYEDVMLENYRNLVSLGLSFRRPNVITLLEKGKAPWMVEPVRRRRAPDSGSKCETKKLPPNQCNKSGQSICQKLVSAQQKAPTRKSGCNKNSVLVKPKKGHSGKKPLKCNDCGKTFSRSFSLKLHQNIHTGEKPFECSNCRKAFRQISSILLHQRIHSGKKSHECNKCGESFNQRTTLILHMRIHDGKEILDCGKALSQCQSFNIHQKIHVVGNVCQCRKCGKAFNQMSSLLLHKKIHNGKKTHKYNKCGRGFKKKSVFVVHKRIHAGEKIPENAKALSQSLQQRSHHLENPFKCRKCGKLFNRISPLMLHQRIHTSEKPYKCDKCDKFFRRLSTLILHLRIHNGEKLYRCNKCEKVCNRHSSLIQHQKVHTKKKKLFECKECGKMFSGTANLKIHQNIHSEEKPFKCNKCSKVFGRQSFLIEHQRIHTGEKPYQCEECGKAFSHRISLTRHKRIHTEDRPYECDQCGKAFSQSAHLAQHERIHTGEKPYTCKTCGKAFSQRTSLILHERSHTGEKPYECNECGKAFSSGSDLIRHQRSHSSEKPYECSKCGKAYSRSSSLIRHQNTHSEEKA

SEQ ID NO: 16332 - protein, 619 aa, Homo Sapiens [sequence omitted]

SEQ ID NO: 16333 - protein, 464 aa, Homo Sapiens
MVSGLRLASRSGEEGWLKPAVARLGPPRHRLRNLRTESPWRSRGSVLFCSGPGRAGRAAEPLHPVCTCGRHFRRPEPCREPLASPIQDSVAFEDVAVNFTQEEWALLDSSQKNLYREVMQETCRNLASVGSQWKDQNIEDHFEKPGKDIRNHIVQRLCESKEDGQYGEVVSQIPNLDLNENISTGLKPCECSICGKVFVRHSLLNRHILAHSGYKPYGEKQYKCEQCGKFFVSVPGVRRHMIMHSGNPAYKCTICGKAFYFLNSVERHQRTHTGEKPYKCKQCGKAFTVSGSCLIHERTHTGEKPYECKECGKTFRFSCSFKTHERTHTGERPYKCTKCDKAFSCSTSLRYHGSIHTGERPYECKQCGKAFSRLSSLCNHRSTHTGEKPYECKQCDQAFSRLSSLHLHERIHTGEKPYECKKCGKAYTRSSHLTRHERSHDIEAGCSDSAYNPSTLGGQGVWIA

SEQ ID NO: 16334 - protein, 389 aa, Homo Sapiens
MDSVSFEDVAVAFTQEEWALLDPSQKNLYRDVMQEIFRNLASVGNKSEDQNIQDDFKNPGRNLSSHVVERLFEIKEGSQYGETFSQDSNLNLNKKVSTGVKPCECSVCGKVFICHSALHRHILSHIGNKLFECEECPEKLYHCKQCGKAFISLTSVDRHMVTHTSNGPYKGPVYEKPFDFPSVFQMPQSTYTGEKTYKCKHCDKAFNYSSYLREHERTHTGEKPYACKKCGKSFTFSSSLRQHERSHTGEKPYECKECGKAFSRSTYLGIHERTHTGEKPYECIKCGKAFRCSRVLRVHERTHSGEKPYECKQCGKAFKYSSNLCEHERTHTGVKPYGCKECGKSFTSSSALRSHERTHTGEKPYECKKCGKAFSCSSSLRKHERAYMW

SEQ ID NO: 16335 - protein, 534 aa, Homo Sapiens
MLSPVSRDASDALQGRKCLRPRSRRLPLPAAVRAHGPMAELTDSARGCVVFEDVFVYFSREEWELLDDAQRLLYHDVMLENFALLASLGIAFSRSRAVMKLERGEEPWVYDQVDMTSATEREAQRGLRPGCWHGVEDEEVSSEQSIFVAGVSEVRTLMAELESHPCDICGPILKDTLHLAKYHGGKARQKPYLCGACGKQFWFSTDFDQHQNQPNGGKLFPRKEGRDSVKSCRVHVPEKTLTCGKGRRDFSATSGLLQHQASLSSMKPHKSTKLVSGFLMGQRYHRCGECGKAFTRKDTLARHQRIHTGERPYECNECGKFFSQSYDLFKHQTVHTGERPYECSECGKFFRQISGLIEHRRVHTGERLYQCGKCGKFFSSKSNLIRHQEVHTGARPYVCSECGKEFSRKHTLVLHQRTHTGERPYECSECGKAFSQSSHLNVHWRIHSSDYECSRCGKAFSCISKLIQHQKVHSGEKPYECSKCGKAFTQRPNLIRHWKVHTGERPYVCSECGREFIRKQTLVLHQRVHAGEKL

SEQ ID NO: 16336 - protein, 452 aa, Homo Sapiens
MFATSGAVAAGKPYSCSECGKSFCYSSVLLRHERAHGGDGRFRCLECGERCARAADLRAHRRTHAGQTLYICSECGQSFRHSGRLDLHLGAHRQRCRTCPCRTCGRRFPHLPALLLHRRRQHLPERPRRCPLCARTFRQSALLFHQARAHPLGTTSDPAAPPHRCAQCPRAFRSGAGLRSHARIHVSRSPTRPRVSDAHQCGVCGKCFGKSSTLTRHLQTHSGEKPFKCPECGKGFLESATLVRHQRTHTGEKPYACGDCGRCFSESSTLLRHRRSHQGERPHACATCGKGFGQRSDLVVHQRIHTGEKPFACPECGRRFSDRSDLTKHRRTHTGEKPYRCELCGKRFTCVSNLNVHRRNHAGHKPHKCPECSKAFSVASKLALHRKTHLGERPAECAECGKCFSHSRSLSQHQRAHTRARTAAAVAIQSAVGTALVFEGPAEQEKPGFSVS

SEQ ID NO: 16337 - protein, 581 aa, Homo Sapiens
MAMSQESLTFKDVFVDFTLEEWQQLDSAQKNLYRDVMLENYSHLVSVGHLVGKPDVIFRLGPGDESWMADGGTPVRTCAGEDRPEVWEVDEQIDHYKESQDKFLWQAAFIGKETLKDESGQECKICRKIIYLNTDFVSVKQRLPKYYSWERCSKHHLNFLGQNRSYVRKKDDGCKAYWKVCLHYNLHKAQPAERFFDPNQRGKALHQKQALRKSQRSQTGEKLYKCTECGKVFIQKANLVVHQRTHTGEKPYECCECAKAFSQKSTLIAHQRTHTGEKPYECSECGKTFIQKSTLIKHQRTHTGEKPFVCDKCPKAFKSSYHLIRHEKTHIRQAFYKGIKCTTSSLIYQRIHTSEKPQCSEHGKASDEKPSPTKHWRTHTKENIYECSKCGKSFRGKSHLSVHQRIHTGEKPYECSICGKTFSGKSHLSVHHRTHTGEKPYECRRCGKAFGEKSTLIVHQRMHTGEKPYKCNECGKAFSEKSPLIKHQRIHTGERPYECTDCKKAFSRKSTLIKHQRIHTGEKPYKCSECGKAFSVKSTLIVHHRTHTGEKPYECRDCGKAFSGKSTLIKHQRSHTGDKNL

SEQ ID NO: 16338 - protein, 568 aa, Homo Sapiens
MGLLTFRDVAIEFSLEEWQCLDTAQRNLYKNVILENYRNLVFLGIAVSKQDLITCLEQEKEPLTVKRHEMVNEPPVMCSHFAQEFWPEQNIKDSFEKVTLRRYEKCGNDNFQLKGCKSVDECKLHKGGYNGLNQCLPTMQSKMFQCDKYVKVFNKFSHSDRHKIKHMENKPFKCKECGRSFCMLSHLTRHERNYTKVNFCKCEECEKAVNQSSKLTKHKRIYTCEKLYKCQECDRTFNQFSNLTEYKKDYAREKPYKCEECGKAFNQSSHLTTHKIIHTGEKPYKCEECGKAFNQFSNLTTHKKIHTGEQPYICEECGKAFTQSSTLTTHKRIHTGEKPYKCEECGKAFNRSSKLTEHKNIHTGEQPYKCEECGKAFNRSSNLTEHRKIHTEEKPYKCKECGKAFKHSSALTTHKRIHTGEKPYKCEECGKAFNRSSKLTEHKKLHTGKKPYKCEECGKAFIQSSKLTEHKKIHSGEIPYKCEECGKAFKHSSSLTTHKRIHTGEKPYKCEECGKAFSRSSKLTEHKIIHTGEKPYKCERCDKAFNQSANLTKHKKIHTGEKLQNWNV

SEQ ID NO: 16339 - protein, 588 aa, Homo Sapiens
MLENYRNLVFLGIAAFKPDLIIFLEQGKEPWNMKRHEMVEEPPVICSHFSQEFWPEQGIEDSFQKMILRRYDKCGHENLHLKISCTNVDECNVHKEGYNKLNQSLTTTQSKVFQCGKYANVFHKCSNSNRHKIRHTGEKGLKCKEYVRSFCMLSHLSQHERIYTRENSYKCEENGKAFNWSSTLTYYKSIHTGEKPYKCEECGKAFSKFSILTKHKVIHTGEKPYKCEECGKAFNRSSILTKHKIIHTGEKPYKCEECGKGFSSVSTLNTHKAIHAEEKPYKCEECGKASNSSSKLMEHKRIHTGEKPYKCEECGKAFSWSSSLTEHKRIHAGEKPYKCEECGKAFNRSSILTKHKIIHTGEKPYKCEGCGKAFSKVSTLNTHKAIHAEEKPYKCEECGKASNSSSKLMEHKRIHTGEKPYKCEECGKAFSWSSSLTEHKRIHAGEKPYKCEECGKAFTWSSSFTKHKRIHAAEKPYKCEECGKGFSTFSILTKHKIIHTGEKRYKCEECGKAFSWSSILTEHKIIHTGEKPYKCEECGKAFSRSSSLTRHKRIHTGEKPYKCEECGKAFKSSSTVSYHKKIHTGENP

SEQ ID NO: 16340 - protein, 584 aa, Homo Sapiens
MALSQGLFTFKDVAIEFSQEEWECLDPAQRALYRDVMLENYRNLLSLDEDNIPPEDDISVGFTSKGLSPKENNKEELYHLVILERKESHGINNFDLKEVWENMPKFDSLWDYDVKNYKGMPLTCNKNLTHRKDQQHNKSSIHFSLKQSVSIRDSAHQYFIHDKPFIRNLLKLKNNIRYAGNKYVKCFENKIGLSLQAQLAELQRFQTGEKMYECNPVEKSINSSSVSPLPPCVKNICNKYRKILKYPLLHTQYGRTHIREKSYKCNDCGKAFSKSSNLTNHQRIHSGQRPYKCNECGKAFNQCSNLTRHQRVHTGEKPYQCNICGKVCSQNSNLASHQRMHTGEKPYKCNECGKAFIQRSHLWGHERIHTGEKPYKCNECDKAFAERSSLTQHKRIHTGEKPYICNECGKAFKQCSHLTRHQNIHPGEKPHKCNVCGRAFIQSSSLVEHQRIHTGEKPYKCNKCDKAFIKRSHLWGHQRTHTGEKPYKCTECGKAFTERSNLTQHKKIHTGEKPYKCTECGKAFTQFANLTRHQKIHIEKKHCKHNIHGNALFQSSNLGDHQKSYNREKHIKYNETKIKYSSCT

SEQ ID NO: 16341 - protein, 525 aa, Homo Sapiens
MGTISLCIGVCAFEGANTSTSFYKLVYTAILSYSIQDLLPEQDMKDLCQKVTLTRHRSWGLDNLHLVKDWRTVNEGKGQKEYCNRLTQCSSTKSKIFQCIECGRNFSWRSILTEHKRIHTGEKPYKCEECGKVFNRCSNLTKHKRIHTGEKPYKCDECGKVFNWWSQLTNHKKIHTGEKPYKCDECDKVFNWWSQLTSHKKIHSGEKPYPCEECGKAFTQFSNLTQHKRIHTGEKPYKCKECCKAFNKFSNLTQHKRIHTGEKPYKCEECGNVFNECSHLTRHRRIHTGEKPYKCEECGKAFTQFASLTRHKRIHTGEKPYQCEECGKTFNRCSHLSSHKRIHTGEKPYKCEECGRTFTQFSNLTQHKRIHTGEKPYKCKECGKAFNKFSSLTQHRRIHTGVKPYKCEECGKVFKQCSHLTSHKRIHTGEKPYKCKECGKAFYQSSILSKHKRIHTEEKPYKCEECGKAFNQFSSLTRHKRIHTGEKRYKCKECGKGFYQSSIHSKYKRIYTGEEPDKCKKCGSL

SEQ ID NO: 16342 - protein, 411 aa, Homo Sapiens
MAKRPGSPGSREMGLLTFRDVVIEFSLEEWQCLDHAQQNLYRDVMLENYRNLVSLGIAVSKPDLITCLEQNKEPWNIKRNEMVTKHPVMCSHFTQDLPPELGIKDSLQKVIPRRYGKSGHDNLQVKTCKSMGECEVQKGGCNEVNQCLSTTQNKIFQTHKCVKVFGKFSNSNRHKTRHTGKKHFKCKKYGKSFCMVSQLHQHQIIHTRENSYQCEECGKPFNCSSTLSKHKRIHTGEKPYRCEECGKAFTWSSTLTKHRRIHTGEKPYTCEECGQAFSRSSTLANHKRIHTGEKPYTCEECGKAFSLSSSLTYHKRIHTGEKPYTCEECGKAFNCSSTLKKHKIIHTGEKPYKCKECGKAFAFSSTLNTHKRIHTGEEPYKCEECDKAFKWSSSLANHKSMHTGEKPYKCE

SEQ ID NO: 16343 - protein, 530 aa, Homo Sapiens
MPGPPGSLEMGPLTFRDVAIEFSLEEWQCLDTAQRNLYRKVMFENYRNLVFLGIAVSKPHLITCLEQGKEPWNRKRQEMVAKPPVIYSHFTEDLWPEHSIKDSFQKVILRGYGKCGHENLQLRISCKSVDESKVFKEGYNELNQCLRTTQSKIFQCDKYVKVFHKFSNSNSHKKRNTGKKVFKCKECGKSFCMLSHLTQHIRIHTRENSYKCEECGKVLNWFSELIKHKGIHMGEKPYKCEECGKAFNQSSTLIKHKKIHIEEKPFKCEECGKAFSLFSILSKHKIIHTGDKPYKCDECHKAFNWFATLTNHKRIHTGEKPFKCEECGKDFNQFSNLTKHKKIHTGEKPYKCEECGKAFNQFANLTRHKKIHTGEKSYKCEECGKAFIQSSNLTEHMRIHTGEKPYKCEECGKAFNGCSSLTRHKRIHTRENTYKCEECGKGFTLFSTLTNHKVIHTGEKSYKCDECGNVFNWPATLANHKRIHAREKPYKCEECGKAFNRSSHLTRHKKIHTGEKLYKPEKCDNNFDNT

SEQ ID NO: 16344 - protein, 645 aa, Homo Sapiens
MEPLKFRDVAIEFSLEEWQCLDTIQQNLYRNVMLENYRNLVFLGIVVSKPDLITCLEQEKEPWTRKRHRMVAEPPVICSHFAQDFSPEQNIKDSFQKVTPRRYGKCEHENLQLSKSVDECKVQKGGYNGLNQCLPTTQSKIFQCDKYMKIFHKFSNLNGHKVRHTRKKPFKYKEFGKSFCIFSNLTQHKIICTRVNFYKCEDCGKAFNGSSIFTKHKRIHIGEKSYICEECGKACNQFTNLTTHKIIYTRDKLYKREECSKAFNLSSHITTHTIIHTGENPYKREECDKAFNQSLTLTTHKIIHTREKLNEYKECGKAFNQSSHLTRHKIIHTGEKPYKCEECGKAFNQSSHLTRHKIIHTGEKPYRCEECGKAFRQSSHLTTHKIIHTGEKPYKCEECGKAFNKSSHLTRHKSIHTGEKPYQCEKCGKASNQSSNLTEHKNIHTEEKPYKCEECGKAFNQFSNLTTHKRIHTGEKPYKCEECGKAFNQSSILTTHKRIHTGEKSYKCEECGKAFYRSSKLTEHKKIHTGEKPYTCEECGKAFNHSSHLATHKVIHTGEKPYQCEECGKAFNQSSHLTRHKRIHTGEKPYQCEKCGKAFNQSSNLTGHKKIHTGEKLYKPKRCNSDFENTSKFSKHKRNYAGEKS

SEQ ID NO: 16345 - protein, 498 aa, Homo Sapiens
MELLTFRDVTIEFSLEEWEFLNPAQQSLYRKVMLENYRNLVSLGLTVSKPELISRLEQRQEPWNVKRHETIAKPPAMSSHYTEDLLPEQCMQDSFQKVILRRYGSCGLEDLHLRKDGENVGECKDQKEIYNGLNQCLSTLPSKIFPYNKCVKVFSKSSNLNRENIRHTTEKLFKCMQCGKVFKSHSGLSYHKIIHTEEKLCICEECGKTFKWFSYLTKHKRIHTGEKPYKCEECGKAFNWCSSLTKHKRIHTGEKPYKCEECGKAFHWCSPFVRHKKIHTGEKPYTCEDCGRAFNRHSHLTKHKTIHTGKKPYKCKECGKAFNHCSLLTIHERTHTGEKPYKCEECGKAFNSSSILTEHKVIHSGEKPYKCEKCDKVFKRFSYLTKHKRIHTGEKPYKCEECGKAFNWSSILTEHKRIHTGEKPYNCEECGKAFNRCSHLTRHKKIHTAVKRYKCEECGKAFKRCSHLNEHKRVQRGEKSCKYKKCGEAFNHCSNLTT

SEQ ID NO: 16346 - protein, 524 aa, Homo Sapiens
MKEESAAQLGCCHRPMALGGTGGSLSPSLDFQLFRGDQVFSACRPLPDMVDAHGPSCASWLCPLPLAPGRSALLACLQDLDLNLCTPQPAPLGTDLQGLQEDALSMKHEPPGLQASSTDDKKFTVKYPQNKDKLGKQPERAGEGAPCPAFSSHNSSSPPPLQNRKSPSPLAFCPCPPVNSISKELPFLLHAFYPGYPLLLPPPHLFTYGALPSDQCPHLLMLPQDPSYPTMAMPSLLMMVNELGHPSARWETLLPYPGAFQASGQALPSQARNPGAGAAPTDSPGLERGGMASPAKRVPLSSQTGTAALPYPLKKKNGKILYECNICGKSFGQLSNLKVHLRVHSGERPFQCALCQKSFTQLAHLQKHHLVHTGERPHKCSIPWVPGRNHWKSFQAWREREVCHKRFSSSSNLKTHLRLHSGARPFQCSVCRSRFTQHIHLKLHHRLHAPQPCGLVHTQLPLASLACLAQWHQGALDLMAVASEKHMGYDIDEVKVSSTSQGKARAVSLSSAGTPLVMGQDQNN

SEQ ID NO: 16347 - protein, 378 aa, Homo Sapiens
MISFQESVTFQDVAVDFTAEEWQLLDCAERTLYWDVMLENYRNLISVGCPITKTKVILKVEQGQEPWMVEGANPHESSPESDYPLVDEPGKHRESKDNFLKSVLLTFNKILTMERIHHYNMSTSLNPMRKKSYKSFEKCLPPNLDLLKYNRSYTVENAYECSECGKAFKKKFHFIRHEKNHTRKKPFECNDCGKAYSRKAHLATHQKIHNGERPFVCNDCGKAFMHKAQLVVHQRLHTGEKPYECSQCGKTFTWNSSFNQHVKSHTLEKSFECKECGKTFRYSSSLYKHSRFHTGEKPYQCIICGKAFGNTSVLVTHQRIHTGEKPYSCIECGKAFIKKSHLLRHQITHTGEKPYECNRCGKAFSQKSNLIVHQKIHT

SEQ ID NO: 16348 - protein, 1237 aa, Homo Sapiens
MGDMKTPDFDDLLAAFDIPDIDANEAIHSGPEENEGPGGPGKPEPGVGSESEDTAAASAGDGPGVPAQASDHGLPPPDISVVSVIVKNTVCPEQSEALAGGSAGDGAQAAGVTKEGPVGPHRMQNGFGSPEPSLPGTPHSPAPPSGGTWKEKGMEGKTPLDLFAHFGPEPGDHSDPLPPSAPSPTREGALTPPPFPSSFELAQENGPGMQPPVSSPPLGALKQESCSPHHPQVLAQQGSGSSPKATDIPASASPPPVAGVPFFKQSPGHQSPLASPKVPVCQPLKEEDDDEGPVDKSSPGSPQSPSSGAEAADEDSNDSPASSSSRPLKVRIKTIKTSCGNITRTVTQVPSDPDPPAPLAEGAFLAEASLLKLSPATPTSEGPKVVSVQLGDGTRLKGTVLPVATIQNASTAMLMAASVARKAVVLPGGTATSPKMIAKNVLGLVPQALPKADGRAGLGTGGQKVNGASVVMVQPSKTATGPSTGGGTVISRTQSSLVEAFNKILNSKNLLPAYRPNLSPPAEAGLALPPTGYRCLECGDAFSLEKSLARHYDRRSMRIEVTCNHCARRLVFFNKCSLLLHAREHKDKGLVMQCSHLVMRPVALDQMVGQPDITPLLPVAVPPVSGPLALPALGKGEGAITSSAITTVAAEAPVLPLSTEPPAAPATSAYTCFRCLECKEQCRDKAGMAAHFQQLGPPAPGATSNVCPTCPMMLPNRCSFSAHQRMHKNRPPHVCPECGGNFLQANFQTHLREACLHVSRRVGYRCPSCSVVFGGVNSIKSHIQTSHCEVFHKCPICPMAFKSGPSAHAHLYSQHPSFQTQQAKLIYKCAMCDTVFTHKPLLSSHFDQHLLPQRVSVFKCPSCPLLFAQKRTMLEHLKNTHQSGRLEETAGKGAGGALLTPKTEPEELAVSQGGAAPATEESSSSSEEEEVPSSPEPPRPAKRPRRELGSKGLKGGGGGPGGWTCGLCHSWFPERDEYVAHMKKEHGKSVKKFPCRLCERSFCSAPSLRRHVRVNHEGIKRVYPCRYCTEGKRTFSSRLILEKHVQVRHGLQLGAQSPGRGTTLARGSSARAQGPGRKRRQSSDSCSEEPDSTTPPAKSPRGGPGSGGHGPLRYRSSSSTEQSLMMGLRVEDGAQQCLDCGLCFASPGSLSRHRFISHKKRRGVGKASALGLGDGEEEAPPSRSDPDGGDSPLPASGGPLTCKVCGKSCDSPLNLKTHFRTHGMAFIRARQGAVGDN

SEQ ID NO: 16349 - protein, 276 aa, Homo Sapiens
MAPPPAPLLAPRPGETRPGCRKPGTVSFADVAVYFSPEEWGCLRPAQRALYRDVMQETYGHLGALGFPGPKPALISWMEQESEAWSPAAQDPEKGERLGGARRGDVPNRKEEEPEEVPRAKGPRKAPVKESPEVLVERNPDPAISVAPARAQPPKNAAWDPTTGAQPPAPIPSMDAQAGQRRHVCTDCGRRFTYPSLLVSHRRMHSGERPFPCPECGMRFKRKFAVEAHQWIHRSCSGGRRGRRPGIRAVPRAPVRGDRDPPVLFRHYPDIFEECG

SEQ ID NO: 16350 - protein, 500 aa, Homo Sapiens
MAPPSAPLPAQGPGKARPSRKRGRRPRALKFVDVAVYFSPEEWGCLRPAQRALYRDVMRETYGHLGALGCAGPKPALISWLERNTDDWEPAALDPQEYPRGLTVQRKSRTRKKNGEKEVFPPKEAPRKGKRGRRPSKPRLIPRQTSGGPICPDCGCTFPDHQALESHKCAQNLKKPYPCPDCGRRFSYPSLLVSHRRAHSGECPYVCDQCGKRFSQRKNLSQHQVIHTGEKPYHCPDCGRCFRRSRSLANHRTTHTGEKPHQCPSCGRRFAYPSLLAIHQRTHTGEKPYTCLECNRRFRQRTALVIHQRIHTGEKPYPCPDCERRFSSSSRLVSHRRVHSGERPYACEHCEARFSQRSTLLQHQLLHTGEKPYPCPDCGRAFRRSGSLAIHRSTHTEEKLHACDDCGRRFAYPSLLASHRRVHSGERPYACDLCSKRFAQWSHLAQHQLLHTGEKPFPCLECGRCFRQRWSLAVHKCSPKAPNCSPRSAIGGSSQRGNAH

SEQ ID NO: 16351 - protein, 566 aa, Homo Sapiens
MPCCSHRRCREDPGTSESQEMDPVAFDDVAVNFTQEEWALLDISQRKLYKEVMLETFRNLTSVGKSWKDQNIEYEYQNPRRNFRSLIEKKVNEIKDDSHCGETFTQVPDDRLNFQEKKASPEIKSCDSFVCGEVGLGNSSFNMNIRGDIGHKAYEYQEYGPKPCKCQQPKKAFRYHPSFRTPQRDHTGEKPYACKECGKTFISHSSIQRHVVMHSGDGPYKCKFCGKAFHCLSLYLIHERIHTGEKPYECKQCGKSFSYSATLRIHERTHTGEKPYECQQCGKAFHSPRCYRRHERIHTGEKAYQCKECGKAFTCPQYVRIHERTHSRKKPYECTQCGKALSSLTSFQTHIRMHSGERPYECKICGKGFCSANSFQRHEKTHSGEKPYKCKQCGKAFIHSSSLRYHERIHTGEKPYECKQCGKAFRSSSHLQLHGRTHTGEKPYECQECGKAFRSMKNLQSHERTQTHVRIHSGERPYKCKLCGKGFYCPKSLQRHEKTHTGEKLYECKQCGEAFSSSSSFRYHERTHTGEKPYKCKQCGKAFRAASVLRMHGRTHPEDKPYECKQ

SEQ ID NO: 16352 - protein, 312 aa, Homo Sapiens
MSLCSPTHSAEMSLFLQGPEEMLPLSSEGSEMGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLKPFIPLWRMVLYSL

SEQ ID NO: 16353 - protein, 519 aa, Homo Sapiens
MASSPAVDVSCRRREKRRQLDARRSKCRIRLGGHMEQWCLLKERLGFSLHSQLAKFLLDRYTSSGCVLCAGPEPLPPKGLQYLVLLSHAHSRECSLVPGLRGPGGQDGGLVWECSAGHTFSWGPSLSPTPSEAPKPASLPHTTRRSWCSEATSGQELADLESEHDERTQEARLPRRVGPPPETFPPPGEEEGEEEEDNDEDEEEMLSDASLWTYSSSPDDSEPDAPRLLPSPVTCTPKEGETPPAPAALSSPLAVPALSASSLSSRAPPPAEVRVQPQLSRTPQAAQQTEALASTGSQAQSAPTPAWDEDTAQIGPKRIRKAAKRELMPCDFPGCGRIFSNRQYLNHHKKYQHIHQKSFSCPEPACGKSFNFKKHLKEHMKLHSDTRDYICEFCARSFRTSSNLVIHRRIHTGEKPLQCEICGFTCRQKASLNWHQRKHAETVAALRFPCEFCGKRFEKPDSVAAHRSKSHPALLLAPQESPSGPLEPCPSISAPGPLGSSEGSRPSASPQAPTLLPQQ

SEQ ID NO: 16354 - protein, 515 aa, Homo Sapiens
MGLLAFRDVALEFSPEEWECLDPAQRSLYRDVMLENYRNLISLGEDSFNMQFLFHSLAMSKPELIICLEARKEPWNVNTEKTARHSVLSSYLTEDILPEQGLQVSFQKVMLRRYERCCLEKLRLRNDWEIVGEWKGQKASYNGLDLCSATTHSKNFQCNKCVKGFSKFANLNKCKISHTGEKPFKCKECGNVSCMSLIMTQQQRIHIGENPYQCKKCGKAFNECSCFTDCKRIHVGEKHCKCEECNNIFKSCSSLAVVEKNHTEKKTYRCEECGKAFNLCSVLTKHKKIHTGEKPYKCEECGKSFKLFPYLTQHKRIHSREKPYKCEECGKVFKLLSYLTQHRRIHTGEKTFRCEECGKAFNQSSHLTEHRRIHTGEKPYKCEECGKAFTWFSYLIQHKRIHTGQKPYKCEECGKAFTWFSYLTQHKRIHTGEKPYKCDECGKAFNWFSYLTNHKRIHTGEKPYKCEECGKAFGQSSHLSKHKTIHTREKPYKCEECGKAFNHSAQLAVHEKTHT

SEQ ID NO: 16355 - protein, 374 aa, Homo Sapiens
MEPGGEPTGAKESSTLMESLAAVKAAFLAQAPSGSRSAEVQAAQSTEPAAEAGAPEGEGHRGGPPRALGSLGLCENQEARERPGGSPRGPVTSEKTGGQSGLESDVPPNAGPGAEGGGSWKGRPFPCGACGRSFKCSSDAAKHRSIHSGEKPYECSDCGKAFIHSSHVVRHQRAHSGERPYACAECGKAFGQSFNLLRHQRVHTGEKPYACADCGKAFGQRSDAAKHRRTHTGERLYACGECGKRFLHSSNVVRHRRTHHGENPYECRECGQAFSQSSNLLQHQRVHTGERPFACQDCGRAFSRSSFLREHRRIHTGEKPHQCGHCGRAFRALSGFFRHQRLHTGEKPFRCTECGRAFRLSFHLIQHRRVHGAE

SEQ ID NO: 16356 - protein, 545 aa, Homo Sapiens
MKQEDNQGVCAHQDSEDKGMGSDFEDSEDREGDPEEREMGSNPHDTNKREGHPEPEMGSNPQDSRHREAVPDICTEGQLSEEEGVSVRGEEDDQSGVADMAMFPGLSESDSISRSLREDDDESAGENRLEEEEEQPAPPVLPWRRHLSLGSRHRGDKPAHRRFHRLHHPMAVDLGELDSLVASIMDAPTICPDCGESFSPGAAFLQHQRIHRLAEAAAAASLEPFGLAGECDAMVGMMGVGVAGGFGAGPPLARPPREKPFRCGECGKGFSRNTYLTNHLRLHTGERPNLCADCGKSFSWRADLLKHRRLHTGEKPYPCPECGEAFSLSSHLLSHRRAHAAASGAGAAALRPFACGECGKGFVRRSHLANHQRIHTGEKPHGCGECGKRFSWRSDLVKHQRVHTGEKPYMCSECGETFSVSSHLFTHKRTHSGERPYVCRECGKGFGRNSHLVNHLRVHTGEKPFRCGQCEKRFSDFSTLTQHQRTHTGEKPYTCIECGKSFIQSSHLIRHRRIHTGNKPHKCAGCGKGFRYKTHLAQHQKLHLC

SEQ ID NO: 16357 - protein, 642 aa, Homo Sapiens
MEEERKTAELQKNRIQDSVVFEDVAVDFTQEEWALLDLAQRNLYRDVMLENFQNLASLGYPLHTPHLISQWEQEEDLQTVKRELIQGIFMGEHREGFETQLKTNESVASQDICGEKISNEQKIVRFKRNDSWFSSLHENQESCGIDYQNKSHERHLRNHMVENIYECYEENQDGQTFSQVPNLDSLKRNTEVKSCECHECGKAFVDHSSLKSHIRSHTGSKPYQCKECGKAFHFLACFKKHMKTPTEEKPYECKECTKAFSCSSFFRAHMKIHIGKTNYECKECGKGFSCSSSLTEHKRIHSGDKPYECKECGKAFSCSSSLSKHKRIHSGDKPYECKECGKAFSSSSHLIIHIRIHTGEKPYECKECGKAFSESSKLTVHGRTHTGEKPYKCKECGKAYNCPSSLSIHMRKHTGEKPYECLECGKAFYLPTSLNTHVKNQSREKPYECKECGKAFSCPSSFRAHVRDHTGKIQYECKECGKTFSRSSSLTEHLRTHSGEKPYECKECGKAFISSSHLTVHIRTHTGEKPYECKKCGKAFIYPSALRIHMRTHTGEKPYECKECGKAFRHSSYLTVHARMHTGEKPFECLECGKAFSCPSSFRRHVRSHTGEKPYECKECGKAFVCPAYFRRHVKTHTRENI

SEQ ID NO: 16358 - protein, 686 aa, Homo Sapiens
MEVVTFGDVAVHFSREEWQCLDPGQRALYREVMLENHSSVAGLAGFLVFKPELISRLEQGEEPWVLDLQGAEGTEAPRTSKTDSTIRTENEQACEDMDILKSESYGTVVRISPQDFPQNPGFGDVSDSEVWLDSHLGSPGLKVTGFTFQNNCLNEETVVPKTFTKDAPQGCKELGSSGLDCQPLESQGESAEGMSQRCEECGKGIRATSDIALHWEINTQKISRCQECQKKLSDCLQGKHTNNCHGEKPYECAECGKVFRLCSQLNQHQRIHTGEKPFKCTECGKAFRLSSKLIQHQRIHTGEKPYRCEECGKAFGQSSSLIHHQRIHTGERPYGCRECGKAFSQQSQLVRHQRTHTGERPYPCKECGKAFSQSSTLAQHQRMHTGEKAQILKASDSPSLVAHQRIHAVEKPFKCDECGKAFRWISRLSQHQLIHTGEKPYKCNKCTKAFGCSSRLIRHQRTHTGEKPFKCDECGKGFVQGSHLIQHQRIHTGEKPYVCNDCGKAFSQSSSLIYHQRIHKGEKPYECLQCGKAFSMSTQLTIHQRVHTGERPYKCNECGKAFSQNSTLFQHQIIHAGVKPYECSECGKAFSRSSYLIEHQRIHTRAQWFYEYGNALEGSTFVSRKKVNTIKKLHQCEDCEKIFRWRSHLIIHQRIHTGEKPYKCNDCGKAFNRSSRLTQHQKIHMG

SEQ ID NO: 16359 - protein, 446 aa, Homo Sapiens
MEVPPATKFGETFAFENRLESQQGLFPGEDLGDPFLQERGLEQMAVIYKEIPLGEQDEENDDYEGNFSLCSSPVQHQSIPPGTRPQDDELFGQTFLQKSDLSMCQIIHSEEPSPCDCAETDRGDSGPNAPHRTPQPAKPYACRECGKAFSQSSHLLRHLVIHTGEKPYECCECGKAFSQSSHLLRHQIIHTGEKPYECRECGKAFRQSSALTQHQKIHTGKRPYECRECGKDFSRSSSLRKHERIHTGERPYQCKECGKSFNQSSGLSQHRKIHTLKKPHECDLCGKAFCHRSHLIRHQRIHTGKKPYKCDECGKAFSQSSNLIEHRKTHTGEKPYKCQKCGKAFSQSSSLIEHQRIHTGEKPYECCQCGKAFCHSSALIQHQRIHTGKKPYTCECGKAFRHRSALIEHYKTHTREKPYVCNLCGKSFRGSSHLIRHQKIHSGEKL

SEQ ID NO: 16360 - protein, 531 aa, Homo Sapiens
MGFLHVGQDGLELPTSGDPPASASQSAGITGVSHRTQPPCFEGLTSKDLVREEKTRKRKRKAKESGMALLQGLLTFRDVAIEFSQEEWKCLDPAQRTLYRDVMLENYRNLVSLDTSSKCMMKMFSSTGQGNTEVVHTGTLQIHASHHIGDTCFQEIEKDIHDFVFQWQENETNGHEALMTKTKKLMSSTERHDQRHAGNKPIKNELGSSFHSHLPEVHIFHPEGKIGNQVEKAINDAFSVSASQRISCRPKTRISNKYRNNFLQSSLLTQKREVHTREKSFQRNESGKAFNGSSLLKKHQIIHLGDKQYKCDVCGKDFHQKRYLACHRCHTGENPYTCNECGKTFSHNSALLVHKAIHTGEKPYKCNECGKVFNQQSNLARHHRVHTGEKPYKCEECDKVFSRKSHLERHRRIHTGEKPYKCKVCDKAFRRDSHLAQHTVIHTGEKPYKCNECGKTFVQNSSLVMHKVIHTGEKRYKCNECGKVFNHKSNLACHRRLHTGEKPYKCNECGKVFNRKSNLERHHRLHTGKKS

SEQ ID NO: 16361 - protein, 129 aa, Homo Sapiens
MREKSFQCNESGKAFNCSSLLKKCQIIHLGEKKYKCDICGKVFNQKRYLAYHHRCHTGEKPYKCNQCGKTFSYKSSLVIHKAIHTGEKPHKCNECGKVFNQKAYLASHHRLHTGEKPYKCEECDKVFSR

SEQ ID NO: 16362 - protein, 590 aa, Homo Sapiens
MSDSPAGSNPRTPESSGSGSGGGGKRPAVPAAVSLLPPADPLRQANRLPIRVLKMLSAHTGHLLHPEYLQPLSSTPVSPIELDAKKSPLALLAQTCSQIGKPDPPPSSKLNSVAAAANGLGAEKDPGRSAPGAASAAAALKQLGDSPAEDKSSFKPYSKGSGGGDSRKDSGSSSVSSTSSSSSSSPGDKAGFRVPSAACPPFPPHGAPVSASSSSSSPGGSRGGSPHHSDCKNGGGVGGGELDKKDQEPKPSPEPAAVSRGGGGEPGAHGGAESGASGRKSEPPSALVGAGHVAPVSPYKPGHSVFPLPPSSIGYHGSIVGAYAGYPSQFVPGLDPSKSGLVGGQLSGGLGLPPGKPPSSSPLTGASPPSFLQGLCRDPYCLGGYHGASHLGGSSCSTCSAHDPAGPSLKAGGYPLVYPGHPLQPAALSSSAAQAALPGHPLYTYGFMLQNEPLPHSCNWVAASGPCDKRFATSEELLSHLRTHTALPGAEKLLAAYPGASGLGSAAAAAAAAASCHLHLPPPAAPGSPGSLSLRNPHTLGLSRYHPYGKSHLSTAGGLAVPSLPTAGPYYSPYALYGQRLASASALGYQ

SEQ ID NO: 16363 - protein, 412 aa, Homo Sapiens
MTFTFQSEDLKRDCGKKMSHQHVFSLAMEEDVKTADTKKASRILDHEKENTRSICLLEQKRKVVSSNIDVPPARKSSEELDMDKVTAAMVLTSLSTSPLVRSPPVRPNESLSGSWKEGGCVPSSTSSSGYWSWSAPSDQSNPSTPSPPLSADSFKPFRSPAQPDDGIDEAEASNLLFDEPIPRKRKNSMKVMFKCLWKNCGKVLSTAAGIQKHIRTIHLGRVGDSDYSDGEEDFYYTEIKLNTDSVADGLSSLAPVSPSQSLASPPTFPIPDSSRTETPCAKTETKLMTPLSRSAPTTLYLVHTDHAYQATPPVTIPGSAKFTPNGSSFSISWQSPPVTFTGIPVSPTHHPVGTGEQRQHAHTVLSSPPRGTVSLRKPRGEGKKCRKVYGMENRDMWCTACRWKKACQRFLD

SEQ ID NO: 16364 - protein, 300 aa, Homo Sapiens
MHSLKKVTFEDVAIDFTQEEWAMMDTSKRKLYRDVMLENISHLVSLGYQISKSYIILQLEQGKELWREGREFLQDQNPDRESALKKKHMISMHPITRKDASTSMTMENSLILEDPFECNDSGEDCTHSSTITQRLLTHSGKKPYVSKQCGKSLRNLFSPKPHKQIHTKGKSYQCNLCEKAYTNCFRLRRHKMTHTGERPYACHLCGKAFTQCSHLRRHEKTHTGERPYKCHQCGKAFIQSFNLRRHERTHLGKKCYECDKSGKAFSQSSGFRGNKIIHTGEKPHACLLCGKAFSLSSDLR

SEQ ID NO: 16365 - protein, 300 aa, Homo Sapiens
MHSLEKVTFEDVAIDFTQEEWDMMDTSKRKLYRDVMLENISHLVSLGYQISKSYIILQLEQGKELWREGRVFLQDQNPDRESALKKKHMISMHPIIRKDASTSMTMENSLILEDPFEYNDSGEDCTHSSTITQCLLTHSGKKPCVSKQCGKSLRNLLSPKPRKQIHTKGKSYQCNLCEKAYTNCFYLRRHKMTHTGERPYACHLCGKAFTQCSHLRRHEKTHTGERPYKCHQCGKAFIQSFNLRRHERTHLGQKCYECDKSGKAFSQSSGFRGNKIIHIGEKPHACLLCGKAFSLSSDLR

SEQ ID NO: 16366 - protein, 300 aa, Homo Sapiens
MHSLKKVTFEDVAIDFTQEEWAMMDTSKRKLYRDVMLENISHLVSLGYQISKSYIILQLEQGKELWQEGREFLQDQNPDRESALKKTHMISMHPIIRKDAPTSMTMENSLILEDPFECNDSGEDCTHSSTIIQCLLTHSGKKPYVSKQCGKSLSNLLSPKPHKQIHTKGKSYQCNLCEKAYTNCFHLRRPKMTHTGERPYTCHLCRKAFTQCSHLRRHEKTHTGERPYKCHQCGKAFIQSFNLRRHERTHLGEKWYECDNSGKAFSQSSGFRGNKIIHTGEKPHACLLCGKAFSLSSDLR

SEQ ID NO: 16367 - protein, 300 aa, Homo Sapiens
MHSLKKLTFEDVAIDFTQEEWAMMDTSKRKLYRDVMLENISHLVSLGYQISKSYIILQLEQGKELWREGRVFLQDQNPNRESALKKTHMISMHPITRKDASTSMTMENSLILEDPFECNDSGEDCTRSSTITQCLLTHSGKKPYVSKQCGKSLRNLLSTEPHKQIHTKGKSYQCNLCEKAYTNCFHLRRHKMTHTGERPYACHLCRKAFTQCSHLRRHEKTHTGQRPYKCHQYGKVFIQSFNLQRHERTHLGKKCYECDKSGKAFSQSSGFRGNKIIHTGEKPHACLLCGKAFSLSSNLR

SEQ ID NO: 16368 - protein, 76 aa, Homo Sapiens
MARGQQKIQSQQKNAKKQAGQKKKQGHDQKAAAKAALIYTCTVCRTQMPDPKTFKQHFESKHPKTPLPPELADVQA

SEQ ID NO: 16369 - protein, 371 aa, Homo Sapiens
MDMAQEPVTFRDVAIYFSREEWACLEPSQRALYRDVMLDNFSSVAALGFCSPRPDLVSRLEQWEEPWVEDRERPEFQAVQRGPRPGARKSADPKRPCDHPAWAHKKTHVRRERAREGSSFRKGFRLDTDDGQLPRAAPERTDAKPTAFPCQVLTQRCGRRPGRRERRKQRAVELSFICGTCGKALSCHSRLLAHQTVHTGTKAFECPECGQTFRWASNLQRHQKNHTREKPFCCEACGQAFSLKDRLAQHRKVHTEHRPYSCGDCGKAFKQKSNLLRHQLVHTGERPFYCADCGKAFRTKENLSHHQRVHSGEKPYTCAECGKSFRWPKGFSIHRRLHLTKRFYECGHCGKGFRHLGFFTRHQRTHRHGEV

SEQ ID NO: 16370 - protein, 499 aa, Homo Sapiens
MKRHEMAAKPPAMCSHFAKDLRPEQYIKNSFQQVILRRYGKCGYQKGCKSVDEHKLHKGGHKGLNRCVTTTQSKIVQCDKYVKVFHKYSNAKRHKIRHTGKNPFKCKECGKSFCMLSQLTQHEIIHTGEKPYKCEECGKAFKKSSNLTNHKIIHTGEKPYKCEECGKAFNQSSTLTRHKIIHTGEKLYKCEECGKAFNRSSNLTKHKIVHTGEKPYKCEECGKAFKQSSNLTNHKKIHTGEKPYKCGECGKAFTLSSHLTTHKRIHTGEKPYKCEECGKAFSVFSTLTKHKIIHTEEKPYKCEECGKAFNRSSHLTNHKVIHTGEKPYKCEECGKAFTKSSTLTYHKVIHTGKKPYKCEECGKAFSIFSILTKHKVIHTEDKPYKCEECGKTFNYSSNFTNHKKIHTGEKPYKCEECGKSFILSSHLTTHKIIHTGEKPYKCKECGKAFNQSSTLMKHKIIHTGEKPYKCEECGKAFNQSPNLTKHKRIHTKEKPYKCK

SEQ ID NO: 16371 - protein, 641 aa, Homo Sapiens
MDSVVFEDVAVNFTQEEWALLGPSQKKLYRDVMQETFVNLASIGENWEEKNIEDHKNQGRKLRSHMVERLCERKEGSQFGETISQTPNPKPNKKTFTRVKPYECSVCGKDYMCHSSLNRHMRSHTEHRSYEYHKYGEKSYECKECGKRFSFRSSFRIHERTHTGEKPYKCKQCGKAFSWPSSFQIHERTHTGEKPYECKECGKAFIYHTTFRGHMRMHTGEKPYKCKECGKTFSHPSSFRNHERTHSGEKPYECKQCGKAFRYYQTFQIHERTHTGEKPYQCKQCGKALSCPTSFRSHERIHTGEKPYKCKKCGKAFSFPSSFRKHERIHTGEKPYDCKECGKAFISLPSYRRHMIMHTGNGPYKCKECGKAFDCPSSFQIHERTHTGEKPYECKQCGKAFSCSSSFRMHERTHTGEKPHECKQCGKAFSCSSSVRIHERTHTGEKPYECKQCGKAFSCSSSFRMHERIHTGEKPYECKQCGKAFSFSSSFRMHERTHTGEKPYECKQCGKAFSCSSSFRMHERTHTGEKPYECKQCGKAFSCSSSIRIHERTHTGEKPYECKQCGKAFSCSSSVRMHERTHTGVKPYECKQCDKAFSCSRSFRIHERTHTGEKPYACQQCGKAFKCSRSFRIHERVHSGE

SEQ ID NO: 16372 - protein, 489 aa, Homo Sapiens
MKELDPKNDISEDKLSVVGEATGGPTRNGARGPGSEGVWEPGSWPERPRGDAGAEWEPLGIPQGNKLLGGSVPACHELKAFANQGCVLVPPRLDDPTEKGACPPVRRGKNFSSTSDLSKPPMPCEEKKTYDCSECGKAFSRSSSLIKHQRIHTGEKPFECDTCGKHFIERSSLTIHQRVHTGEKPYACGDCGKAFSQRMNLTVHQRTHTGEKPYVCDVCGKAFRKTSSLTQHERIHTGEKPYACGDCGKAFSQNMHLIVHQRTHTGEKPYVCPECGRAFSQNMHLTEHQRTHTGEKPYACKECGKAFNKSSSLTLHQRNHTGEKPYVCGECGKAFSQSSYLIQHQRFHIGVKPFECSECGKAFSKNSSLTQHQRIHTGEKPYECYICKKHFTGRSSLIVHQIVHTGEKPYVCGECGKAFSQSAYLIEHQRIHTGEKPYRCGQCGKSFIKNSSLTVHQRIHTGEKPYRCGECGKTFSRNTNLTRHLRIHT

SEQ ID NO: 16373 - protein, 664 aa, Homo Sapiens
MEGFMDSGTQTDAVVVLSLAQAAVLGLVSENELFGATISAEAFYPDLGPELSGAAMGEPEPPGPDVYQLACNGRALEEPAEEEVLEVEAACEKHTRRKTRPPVRLVPKVKFEKVEEEEQEVYEVSVPGDDKDAGPAEAPAEAASGGCDALVQSSAVKMIDLSAFSRKPRTLRHLPRTPRPELNVAPYDPHFPAPARDGFPEPSMALPGPEALPTECGFEPPHLAPLSDPEAPSMESPEPVKPEQGFVWQEASEFEADTAGSTVERHKKAQLDRLDINVQIDDSYLVEAGDRQKRWQCRMCEKSYTSKYNLVTHILGHNGIKPHSCPHCSKLFKQPSHLQTHLLTHQGTRPHKCQVCHKAFTQTSHLKRHMLLHSEVKPYSCHFCGRGFAYPSELKAHEVKHESGRCHVCVECGLDFSTLTQLKRHLASHQGPTLYQCLECDKSFHYRSQLQNHMLKHQNVRPFVCTECGMEFSQIHHLKQHSLTHKGVKEFKCEVCGREFTLQANMKRHMLIHTSVRPYQCHICFKTFVQKQTLKTHMIVHSPVKPFKCKVCGKSFNRMYNLLGHMHLHAGSKPFKCPYCSSKFNLKGNLSRHMKVKHGVMDIGLDSQDPMMELTGTDPSELDGQQEMEDFEENAYSYASVDSSAEASVLTEQAMKEMAYYNVL

SEQ ID NO: 16374 - protein, 761 aa, Homo Sapiens
MDSGGGSLGLHTPDSRMAHTMIMQDFVAGMAGTAHIDGDHIVVSVPEAVLVSDVVTDDGITLDHGLAAEVVHGPDIITETDVVTEGVIVPEAVLEADVAIEEDLEEDDGDHILTSELITETVRVPEQVFVADLVTGPNGHLEHVVQDCVSGVDSPTMVSEEVLVTNSDTETVIQAAGGVPGSTVTIKTEDDDDDDVKSTSEDYLMISLDDVGEKLEHMGNTPLKIGSDGSQEDAKEDGFGSEVIKVYIFKAEAEDDVEIGGTEIVTESEYTSGHSVAGVLDQSRMQREKMVYMAVKDSSQEEDDIRDERRVSRRYEDCQASGNTLDSALESRSSTAAQYLQICDGINTNKVLKQKAKKRRRGETRQWQTAVIIGPDGQPLTVYPCHICTKKFKSRGFLKRHMKNHPDHLMRKKYQCTDCDFTTNKKVSFHNHLESHKLINKVDKTHEFTEYTRRYREASPLSSNKLILRDKEPKMHKCKYCDYETAEQGLLNRHLLAVHSKNFPHVCVECGKGFRHPSELKKHMRTHTGEKPYQCQYCIFRCADQSNLKTHIKSKHGNNLPYKCEHCPQAFGDERELQRHLDLFQGHKTHQCPHCDHKSTNSSDLKRHIISVHTKDFPHKCEVCDKGFHRPSELKKHSDIHKGRKIHQCRHCDFKTSDPFILSGHILSVHTKDQPLKCKRCKRGFRQQNELKKHMKTHTGRKIYQCEYCEYSTTDASGFKRHVISIHTKDYPHRCEFCKKGFRRPSEKNQHIMRHHKEALM

SEQ ID NO: 16375 - protein, 430 aa, Homo Sapiens
MEEEEMNDGSQMVRSQESLTFQDVAVDFTREEWDQLYPAQKNLYRDVMLENYRNLVALGYQLCKPEVIAQLELEEEWVIERDSLLDTHPDGENRPEIKKSTTSQNISDENQTHEMIMERLAGDSFWYSILGGLWDFDYHPEFNQENHKRYLGQVTLTHKKITQERSLECNKFAENCNLNSNLMQQRIPSIKIPLNSDTQGNSIKHNSDLIYYQGNYVRETPYEYSECGKIFNQHILLTDHIHTAEKPSECGKAFSHTSSLSQPQMLLTGEKPYKCDECGKRFSQRIHLIQHQRIHTGEKPFICNGCGKAFRQHSSFTQHLRIHTGEKPYKCNQCGKAFSRITSLTEHHRLHTGEKPYECGFCGKAFSQRTHLNQHERTHTGEKPYKCNECGKAFSQSAHLNQHRKIHTREKLCEYKCEQTVRHSPSFSST

SEQ ID NO: 16376 - protein, 554 aa, Homo Sapiens
MNVMLENYKNLVFLAGIAVSKQDPITSLEQEKEPWNMKICEMVDESPAMCSSFTRDLWPEQDIKDSFQQVILRRHGKCEHENLQLRKGSANVVECKVYKKGYELNQCLTTTQSKIFPCDKYIKVFHKIFNSNRHKTRHTGEKPFKCKKCDESFCMLLHLHQHKRIHIRENSYQCEECDKVFKRFSTLTRHKRVHTGEKPFKCEECGKAFKHSSTLTTHKMIHTGEKPYRCEECGKAFYHSSHLTTHKVIHTGEKPFKCEECGKAFNHPSALTTHKFIHVKEKPYKCEECDKAFNRFSYLTKHKIIHSGEKSYKCEQCGKGFNWSSTLTKHKRIHTGEKPYKCEECGKAFNVSSHLTTHKMIHTGEKPYKCEECGKAFNHSSKLTIHKIIHTGEKPYKCEECGKAFNQSSNLTKHKIIHTGEKLYKCEECGKAFNRSSNLTTHKRIHTGEKPYKCEECGKAFNRSSNLTKHNIIHTGEKSYKCEECGKAFNQSSTLTKHRKIQQGMVAHACNPNTLRGLGEQIARSGVQDQPGQHGKTPSLLKIQKFAGCGGRRL

SEQ ID NO: 16377 - protein, 495 aa, Homo Sapiens
MAKRPGPPGSREMGLLTFRDIAIEFSLAEWQCLDHAQQNLYRDVMLENYRNLVSLGIAVSKPDLITCLEQNKEPQNIKRNEMVAKHPVTCSHFTQDLQSEQGIKDSLQKVILRRYGKCGQEDLQVKKCCKSVGECEVHKGGYNYVNQCLSATQNKTFQTHKCVKVFGKFSNSNRHKTRHTGKKHFKCKNDGKSFCMLSRLNQHQIIHTREKSYKCEECGKSFNCSSTLTRHKRIHTGEKPYRCEECGKAFSWSASLTKHKRIHTGEKPYTCEERGKVFSRSTLTNYKRIHTGEKPYTCEECGKAFSRSSTLTNHKRIHTGERPYKCEECGKAFSLSSTLKKHKIVHTGEKLYTCEECGKAFTFSSTLNTHKRIHTGEKPYTCEECGKAFSLPSTFTYHKRTHTGEKPYKCEECGKAFNCSSTLKKHKIIHTGEKLYKCKECGKAFTFSSTLNTHKRIHTGEKPYKCEECDQTFKWHSSLANHKNMHTGEKPYKYE

SEQ ID NO: 16378 - protein, 904 aa, Homo Sapiens
MLETYNSLVSLQELVSFEEVAVHFTWEEWQDLDDAQRTLYRDVMLETYSSLVSLGHCITKPEMIFKLEQGAEPWIVEETPNLRLSAVQIIDDLIERSHESHDRFFWQIVITNSNTSTQERVELGKTFNLNSNHVLNLIINNGNSSGMKPGQFNDCQNMLFPIKPGETQSGEKPHVCDITRRSHRHHEHLTQHHKIQTLLQTFQCNEQGKTFNTEAMFFIHKRVHIVQTFGKYNEYEKACNNSAVIVQVITQVGQPTCCRKSDFTKHQQTHTGEKPYECVECEKPSISKSDLMLQCKMPTEEKPYACNWCEKLFSYKSSLIIHQRIHTGEKPYGCNECGKTFRRKSFLTLHERTHTGDKPYKCIECGKTFHCKSLLTLHHRTHSGEKPYQCSECGKTFSQKSYLTIHHRTHTGEKPYACDHCEEAFSHKSRLTVHQRTHTGEKPYECNECGKPFINKSNLRLHQRTHTGEKPYECNECGKTFHRKSFLTIHQWTHTGEKPYECNECGKTFRCKSFLTVHQRTHAGEKPYACNECGKTYSHKSYLTVHHRTHTGEKPYECNECGKSFHCKSFLTIHQRTHAGKKPYECNECEKTFINKLNLGIHKITHTGERPYECNECGKTFRQKSNLSTHQGTHTGEKPYVCGKTFHRKSFLTIHQRTHTGKNRMDVMNVEKLFVRNHTLLYIRELTPGKSPMNVMNVENPFIRRQIFRSIKVFTRGRNPMNVANVEKPCQKSVLTVHHRTHTGEKPYECNECGKTFCHKSNLSTHQGTHSGEKPYECDECRKTFYDKTVLTIHQRTHTGEKPFECKECRKTFSQKSKLFVHHRTHTGEKPFRCNECRKTFSQKSGLSIHQRTHTGEKPYECKECGKTFCQKSHLSRHQQTHIGEKSDVAEAGYVFPQNHSFFP

SEQ ID NO: 16379 - protein, 478 aa, Homo Sapiens
MELLTFKDVAIEFSPEEWKCLDTSQQNLYRDVMLENYRNLVSLGVSISNPDLVTSLEQRKEPYNLKIHETAARPPAVCSHFTQNLWTVQGIEDSFHKLIPKGHEKRGHENLRKTCKSINECKVQKGGYNRINQCLLTTQKKTIQSNICVKVFHKFSNSNKDKIRYTGDKTFKCKECGKSFHVLSRLTQHKRIHTGENPYTCEECGKAFNWSSILTKHKRIHAREKFYKCEECGKGFTRSSHLTKHKRIHTGEKPYICEKCGKAFNQSSTLNLHKRIHSAQKYYKCEECGKAFKWSSSLNEHKRIHAGEKPFSCEECGNVFTTSSDFAKHKRIHTGEKPYKCEECGKSFNRSTTLTTHKRIHTGEKPYTCEECGKAFNWSSTLNVHKRIHSGKNPYKCEDCGKAFKVFANLHNHKKIHTGEKPYICKQCGKAFKQSSHLNKHKKIHTVDKPYKCKECGKAFKQYSNLPQHKRTHTGGKF

SEQ ID NO: 16380 - protein, 126 aa, Homo Sapiens
MGLLTFRDVAIEFSREEWEHLDSDQKLLYGDVMLENYGNLVSLGLAVSKPDLITFLEQRKEPWNVKSAETVAIQPDIFSHDTQGLLRKKLIEASFQKVILDGYGSCGPQNLNLRKEWESEGKIILW

SEQ ID NO: 16381 - protein, 911 aa, Homo Sapiens
MCSHFTQDFLPVQGIEDSFHKLILRRYEKCGHDNLQLRKGCKSMNVCKVQKGVYNGINKCLSNTQSKIFQCNARVKVFSKFANSNKDKTRHTGEKHFKCNECGKSFQKFSDLTQHKGIHAGEKPYTCEERGKDFGWYTDLNQHKKIHTGEKPYKCEECGKAFNRSTNLTAHKRIHNREKAYTGEDRDRAFGWSTNLNEYKKIHTGDKPYKCKECGKAFMHSSHLNKHEKIHTGEKPYKCKECGKVISSSSSFAKHKRIHTGEKPFKCLECGKAFNISTTLTKHRRIHTGEKPYTCEVCGKAFRQSANLYVHRRIHTGEKPYTCGECGKTFRQSANLYVHRRIHTGEKPYKCEDCGKAFGRYTALNQHKKIHTGEKPYKCEECGKAFNSSTNLTAHKRIHTREKPYTCEDRGRAFGLSTNLNEYKKIHTGDKPYKCKECGKAFIHSLHLNKHEKIHTGKKPYKCKQCGKVITSSSSFAKHKRIHTGEKPFECLECGKAFTSSTTLTKHRRIHTGEKPYTCEVCGKAFRQSAILYVHRRIHTGEKPYTCEECGKTFRQSANLYVHRRIHTGEKPYKCEECGKAFGRYTDLNQHKKIHTGEKLYKCEECGKDFVWYTDLNQQKKIYTGEKPYKCEECGKAFAPSTDLNQHTKILTGEQSYKCEECGKAFGWSIALNQHKKIHTGEKPYKCEECGKAFSRSRNLTTHRRVHTREKPYKCEDRGRSFGWSTNLNEYKKIHTGDKLYKCKECGKVFKQSSHLNRHEKIHTGKKPYKCKECGKVITSSSSFAKHKRIHTGEKPFKCLECGKAFTSSTTLTKHRRIHTGEKPYTCEECGKAFRQSAILYVHRRIHTGEKPYTCGECGKTFRQSANLYAHKKIHTGEKPYTCGDCGKTFRQSANLYAHKKIHTGDKTIQV

SEQ ID NO: 16382 - protein, 619 aa, Homo Sapiens
MGPLTFMDVAIEFSVEEWQCLDTAQQNLYRNVMLENYRNLVFLGIAVSKPDLITCLEQGKEPWNMERHEMVAKPPGMCCYFAQDLRPEQSIKASLQRIILRKYEKCGHHNLQLKKGYKSVDEYKVHKGSYNGFNQCLTTTQSKIFQCDKYVKDFHKFSNSNRHKTEKNPFKCKECGKSFCVLSHLTQHKRIHTTVNSYKLEECGKAFNVSSTLSQHKRIHTGQKHYKCEECGIAFNKSSHLNTHKIIHTGEKSYKREECGKAFNISSHLTTHKIIHTGENAYKCKECGKAFNQSSTLTRHKIIHAGEKPYICEHCGRAFNQSSNLTKHKRIHTGDKPYKCEECGKAFNVSSTLTQHKRIHTGEKPYKCEECGKAFNVSSTLTQHKRIHTGEKPYKCEECGKAFNTSSHLTTHKRIHTGEKPYKCEECGKAFNQFSQLTTHKIIHTGEKPYKCKECGKAFKRSSNLTEHRIIHTGEKPYKCEECGKAFNLSSHLTTHKKIHTGEKPYKCKECGKAFNQSSTLARHKIIHAGEKPYKCEECGKAFYQYSNLTQHKIIHTGEKPYKCEECGKAFNWSSTLTKHKVIHTGEKPYKCKECGKAFNQCSNLTTHKKIHAVEKSDK

SEQ ID NO: 16383 - protein, 738 aa, Homo Sapiens
MGLLTFRDVAIEFSLEEWQCLDTAQKNLYRNVMLENYRNLAFLGIAVSKPDLIICLEKEKEPWNMKRDEMVDEPPGICPHFAQDIWPEQGVEDSFQKVILRRFEKCGHENLQLRKGCKSVDECKVHKEGYNGLNQCFTTTQGKASQCGKYLKVFYKFINLNRYKIRHTRKKPFKCKNCVKSFCMFSHKTQHKSIYTTEKSYKCKECGKTFNWSSTLTNHKKTHTEEKPYKCEEYGKAFNQSSNYTTHKVTHTGEKPYKCEECGKAFSQSSTLTIHKRIHTGEKPCKCEECGKAFSQPSALTIHKRMHIGEKPYKCEECGKAFVWSSTLTRHKRLHSGEKPYKCEECAKAFSQFGHLTTHRIIHTGEKPYKCEECGKAFIWPSTLTKHKRIHTGEKPYKCEECGKAFHRSSNLTKHKIIHTGEKPYKCEECGKAFIWSSNLTEHKKIHTREKPYKCEECSKAFSRSSALTTHKRMHTGEKPYKCEECGKAFSQSSTLTAHKIIHTGEKPYKCEECGKAFILSSTLSKHKRIHTGEKPYKCEECGKTFNQSSNLSTHKIIHTGEKPYKCEECGKAFNRSSNLSTHKIIHTGEKPYKCDECGKSFIWSSTLFKHKRIHTGEKPYKCEECGKAFNHSQILLHIRHKRMHTGEKPYKCEECGKSFNLSSTFIKHKVIHTGVKLYKCEECGKVFFWSSALTRHKKIHAGQQPYKWEKIGKAFNQSSHLTTDKITHIGEKSYKCE

SEQ ID NO: 16384 - protein, 499 aa, Homo Sapiens
MRVLTFRDVAVEFSPEEWECLDSAQQRLYRDVMLENYGNLFSLGLAIFKPDLITYLEQRKEPWNARRQKTVAKHPAGSLHFTAEILLEHDINDSFQKVILRKSGSCDLNTLRLKKDYQRVGNCKGQKSSYNGIHQCLSATRSKTCQYNKCGKAFGLCSIFTEHKKIFSREKCYKCEECGKDCRLSDFTIQKRIHTADRSYKCEECGKACKKFSNLTEHNRVHTGKKPYKCEECGKTFTCSSALTKHKRNHTGDRPYKCEECHKAFRCCSDLTKHKRIHTGEKPYKCKECHKAFRCCSDLTKHKRIHTGEKPYKCNECGKAFMWISALSQHNRIHTGEKPYICEECGKAFTYSSTLISHKRIHMELRPYKCEECGKTFKWFSDLTNHKRIHTGEKPYKCEECGKSFTCSSNLIKHKRIHMEVRPYKCEECGKTFKWFPDLTNHKRIHTGEKPYKCEECGKTFTCSSSLIKHKRSHTGDRPTSAKNVAKPLGGSQTLLNIR

SEQ ID NO: 16385 - protein, 1252 aa, Homo Sapiens
MPGAPGSLEMGPLTFRDVTIEFSLEEWQCLDTVQQNLYRDVMLENYRNLVFLGMAVFKPDLITCLKQGKEPWNMKRHEMVTKPPVMRSHFTQDLWPDQSTKDSFQEVILRTYARCGHKNLRLRKDCKSANEGKMHKEGYNKLNQCRTATQRKIFQCNKHMKVFHKYSNRNKVRHTKKKTFKCIKCSKSFFMLSCLIRHKRIHIRQNIYKCEERGKAFKSFSTLTKHKIIHTEDKPYKYKKCGNAFKFSSTFTKHKRIHTGETPFRCEECGKAFNQSSNLTDHKRIHTGEKTYKCEECGKAFKGSSNFNAHKVIHTAEKPYKCEDCGKTFNHFSALRKHKIIHTGKKPYKREECGKAFSQSSTLRKHEIIHTGEKPYKCEECGKAFKWSSKLTVHKVVHTGEKPYKCEECGKAFSQFSTLKKHKIIHTGKKPYKCEECGKAFNSSSTLMKHKIIHTGEKPYKCEECGKAFRQSSHLTRHKAIHTGEKPYKCEECGKAFNHFSDLRRHKIIHTGKKPYKCEECGKAFSQSSTLRNHQIIHTGEKPYKCEECGKAFKWSSKLTVHKVIHTGEKPCKCEECGKAFKHFSALRKHKVIHTREKLYKCEECGKAFNNSSILAKHKIIHTGKKPYKCEECGKAFRQSSHLTRHKAIHTGEKPYKCEECGKAFSHFSALRRHKIIHTGKKPYKCEECGKAFSHFSALRRHKIIHTGEKPYKCEECGKAFKWSSKLTVHKVIHTAEKPCKCEECGKSFKHFSALRKHKVIHTREKLYKCEECVKAFNSFSALMKHKVIHTGEKPYKCEECGKAFKWSSKLTVHKVIHTGEKPCKCEECGKAFKHFSALRKHKVIHTGKKPYKCEECGKAFSQSSSLRKHEIIHSGEKPYKCEECGKAFKWLSKLTVHKVIHTAEKPCKCEECGKAFKHFSALRKHKIIHTGKKPYKCEECGKAFNDSSTLMKHKIIHTGKKPYKCAECGKAFKQSSHLTRHKAIHTGEKPYKCEECGKDFNNSSTLKKHKLIHTREKLYKCEECVKAFNNFSALMKHKIIHTGEKPYKCEECGKAFKWSSKLTEHKVIHTGEKPCKCEECDKAFKHFSALRKHKVIHTGKKPYQCDECGKAFNNSSTLTKHKIIHTGEKPYKCEECGKAFSQSSILTKHKIIHSVEKPYKCEECGKAFNQSSHLTRHKTIHTGEKPYKCEECGKAFIQCSYLIRHKTIHTREKPTNVKKVPKLLSNPHTLLDKTIHTGEKPYKCEECAKAF

SEQ ID NO: 16386 - protein, 503 aa, Homo Sapiens
MGALTFRDVAIEFSLEEWQCLDTEQQNLYRNVMLDNYRNLVFLGIAVSKPDLITCLEQEKEPWNLKTHDMVAKPPVICSHIAQDLWPEQGIKDYFQEVILRQYKKCRHENLLLRKGCKNVDEFKMHKKGYNRHNQCLTTSHSKIFQCDKYVKVFHKFSNSNRHKIRHTSKKPFKCKECGKLFCILSHLAQHKKIHTGEKSYKCEEYGKAFNESSNCTTHKRITEKKPYKCKECGKAFNWFSHFTTHKRIHTGEKPYQCEKCGKFFNQSTNLTTHKRIHTGEKPYKCEECGKAFNQSSNLTEHKKIHTKEQPYKCEKCGKAFKWSSTLTKHKRIHNGEKPYKCEECGKAFNRSSTLNRHKITHTGGKPYKYKECGKAFNQSSTLTIHKIIHTVEKFYKCEECGKAFSRISHLTTHKRIHTGEKPYKCEECGRAFNQSSTLTTHKRIHTGEKPYECEECGKAFNRSSTLTTHKIIHSGEKIYKCKECGKAFRRFSHLTRHKTIHT

SEQ ID NO: 16387 - protein, 585 aa, Homo Sapiens
MELLTFRDVAIEFSPEEWKCLDPAQQNLYRDVMLENYRNLISLGVAISNPDLVIYLEQRKEPYKVKIHETVAKHPAVCSHFTQDFLPVQGIEDSFHKLILRRYEKCGHENLELRKSCKRKVQKGGYNEFNQCLSTIQSKIFQCNVHVKVFSTFSNSNQRRIRHTGEKHFKECGKSFQKFSDLTQHQGIHAGEKPYTCEECGKDFKWYLIFNEYEIIHTGEKPFTCEECGNIFTTSSNFAKHKVHTGEKSYKYEECGKAFNRSSTLTKHKRIHAEEKPFTCEECGKIITSSSNVAKHKKIHTGEKLYKCQECGKVFNRSTTLTKHNRIHTGEKPYTCEECGKAFSRSSVLNEHKRIHTGEKPYKCEQCGKAFRQSATLNKHKSIHTGEKPYTCEECGKAFSRFTTLNEHKRIHTGERPHKCEECGKAFGWSTDLNKHKIIHTGEKPYKCEECGKAFGWSAYLSKHKKIHTGEKPYRCEECGKAFLCSRALNKHKTIHTGEKPYECEECGKAFGWSTYLSKHKKIHTGEKPYRCEECGKAFRRSRVLNKYKTIHTGDKTPKCKGCGKAFKWSSYLNQHNKIYTGEKL

SEQ ID NO: 16388 - protein, 412 aa, Homo Sapiens
MAKRPGPPGSREMGLLTFRDIAIEFSLAEWQCLDHAQQNLYRDVMLENYRNLFSLGMTVSKPDLIACLEQNKEPQNIKRNEMAAKHPVTCSHFNQDLQPEQSIKDSLQKVIPRTYGKCGHENLQLKKCCKRVDECEVHKGGYNDLNQCLSNTQNKIFQTHKCVKVFSKFSNSNRHNARYTGKKHLKCKKYGKSFCMFSHLNQHQIIHTKEKSYKCEECGKSFNHSSSGTTHKRILTGEKPYRCEECGKAFRWPSNLTRHKRIHTGEKPYACEECGQAFRRSSTLTNHKRIHTGERPYKCEECGKAFSVSSALIYHKRIHTGEKPYTCEECGKAFNCSSTLKTHKIIHTGEKPYTCEECGRTFNCSSTVKAHKRIHTGEKPYKCEECDKAFKWHSSLAKHKIIHTGEKPYKCK

SEQ ID NO: 16389 - protein, 536 aa, Homo Sapiens
MGPLQFRDVAIEFSLEEWHCLDTAQRNLYRNVMLENYRNLVFLGIVVSKPDLITCLEQGKKPLTMKKHEMVANPSVTCSHFARDLWPEQSIKDSFQKVTLRRYENYGHDNLQFKKGCESVDECKVHKRGYNGLNQYLTTTQSKIFQCDKYVKVIHKFSNSNRHKIRHTGKKPFKCIECGKAFNQSSTLTTHKKIHTGEKPFKCEECGKAFNWSSHLTTHKRIHTGEKRYKCEDCGKAFSRFSYLTAHKIIHSGEKPYKCEECGKAFKRSSNLTTHKIIHTGEKPYKCEECGKAFKRSSILTAHKIIHSGEKPYKCEECGKAFKHPSVLTTHKRIHTGEKPYKCEECGRAFKYFSSLTTHKIIHSGEKPYKCEECGKAFNWSSHLTTHKRIHTGEKPYKCEECGEAFKYSSSLTTHKIIHTGQQPFKCEECGKAFKCFSILTTHKRIHTGEKPYKCEECGKAFNSSSHLTAHKRIHTGEKPYKCERCGKAFKRSFILTRHKRIHTGEKPYKCEECGKGFKCPSTLTTHKVIHTGEKL

SEQ ID NO: 16390 - protein, 644 aa, Homo Sapiens
MEIPAPEPEKTALSSQDPALSLKENLEDISGWGLPEARSKESVSFKDVAVDFTQEEWGQLDSPQRALYRDVMLENYQNLLALGPPLHKPDVISHLERGEEPWSMQREVPRGPCPEWELKAVPSQQQGICKEEPAQEPIMERPLGGAQAWGRQAGALQRSQAAPWAPAPAMVWDVPVEEFPLRCPLFAQQRVPEGGPLLDTRKNVQATEGRTKAPARLCAGENASTPSEPEKFPQVRRQRGAGAGEGEFVCGECGKAFRQSSSLTLHRRWHSREKAYKCDECGKAFTWSTNLLEHRRIHTGEKPFFCGECGKAFSCHSSLNVHQRIHTGERPYKCSACEKAFSCSSLLSMHLRVHTGEKPYRCGECGKAFNQRTHLTRHHRIHTGEKPYQCGSCGKAFTCHSSLTVHEKIHSGDKPFKCSDCEKAFNSRSRLTLHQRTHTGEKPFKCADCGKGFSCHAYLLVHRRIHSGEKPFKCNECGKAFSSHAYLIVHRRIHTGEKPFDCSQCWKAFSCHSSLIVHQRIHTGEKPYKCSECGRAFSQNHCLIKHQKIHSGEKSFKCEKCGEMFNWSSHLTEHQRLHSEGKPLAIQFNKHLLSTYYVPGSLLGAGDAGLRDVDPIDALDVAKLLCVVPPRAGRNFSLGSKPRN

SEQ ID NO: 16391 - protein, 193 aa, Homo Sapiens
MAQASLLACEGLAGVSLVPTAASKKMMLSQIASKQAENGERAGSPDVLRCSSQGHRKDSDKSRSRKDDDSLSEASHSKKTVKKVVVVEQNGSFQVKIPKNFVCEHCFGAFRSSYHLKRHILIHTGEKPFECDICDMRFIQKYHLERHKRVHSGEKPYQCERCHQCFSRTDRLLRHKRMCQGCQSKTSDGQFSL

SEQ ID NO: 16392 - protein, 644 aa, Homo Sapiens
MAEAVAAPISPWTMAATIQAMERKIESQAARLLSLEGRTGMAEKKLADCEKTAVEFGNQLEGKWAVLGTLLQEYGLLQRRLENVENLLRNRNFWILRLPPGSKGESPKEWGKLEDWQKELYKHVMRGNYETLVSLDYAISKPEVLSQIEQGKEPCNWRRPGPKIPDVPVDPSPGSGPPVPAPDLLMQIKQEGELQLQEQQALGVEAWAAGQPDIGEEPWGLSQLDSGAGDISTDATSGVHSNFSTTIPPTSWQTDLPPHHPSSACSDGTLKLNTAASTEDVKIVIKTEVQEEEVVATPVHPTDLEAHGTLFGPGQATRFFPSPAQEGAWESQGSSFPSQDPVLGLREPARPERDMGELSPAVAQEETPPGDWLFGGVRWGWNFRCKPPVGLNPRTGPEGLPYSSPDNGEAILDPSQAPRPFNEPCKYPGRTKGFGHKPGLKKHPAAPPGGRPFTCATCGKSFQLQVSLSAHQRSCGAPDGSGPGTGGGGSGSGGGGGGSGGGSARDGSALRCGECGRCFTRPAHLIRHRMLHTGERPFPCTECEKRFTERSKLIDHYRTHTGVRPFTCTVCGKSFIRKDHLRKHQRNHAAGAKTPARGQPLPTPPAPPDPFKSPASKGPLASTDLVTDWTCGLSVLGPTDGGDM

SEQ ID NO: 16393 - protein, 191 aa, Homo Sapiens
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRIRRWRSVRQKRTQQIPETRKRKDKGKGREPWRSPTLWPPGLLG

SEQ ID NO: 16394 - protein, 778 aa, Homo Sapiens
MNLTEDCMVFEDVAIYFSQEEWGILNDAQRHLHSNVMLENFALLSSVGCWHGAKDEEVPSKQCVSVRVLQVTIPKPALSTLKAQPCKMCSSILKDILHLAEHDGTHPEQGLYTCAAEHDLHQKEQIREKLTRSDEWRPSFVNHSAHVGERNFTCTQGGKDFTASSDLLQQQVLNSGWKLYRDTQDGEAFQGEQNDFNSSQGGKDFCHQHGLFEHQKTHNGERPYEFSECGELFRYNSNLIKYQQNHAGERPYEGTEYGKTFIRKSNLVQHQKIHSEGFLSKRSDPIEHQEILSRPTPYECTQCGKAFLTQAHLVGHQKTHTGEQPYECNKCGKFFMYNSKLIRHQKVHTGERRYECSECGKLFMDSFTLGRHQRVHTGERPFECSICGKFFSHRSTLNMHQRVHAGKRLYKCSECGKAFSLKHNVVQHLKIHTGERPYECTECEKAFVRKSHLVQHQKIHTDAFSKRSDLIQHKRIDIRPRPYTCSECGKAFLTQAHLVGHQKIHTGERPYECTQCAKAFVRKSHLVQHEKIHTDAFSKRSDLIQHKRIDLRPRPYVCSECGKAFLTQAHLDGHQKIQTGERRYECNECGKFFLDSYKLVIHQRIHTGEKPYKCSKCGKFFRYRCTLSRHQKVHTGERPYECSECGKFFRDSYKLIIHQRVHTGEKPYECSNCGKFLRYRSTFIKHHKVCTGEKPHECSKCRELFRTKSSLIIHQQSHTGESPFKLRECGKDFNKCNTGQRQKTHTGERSYECGESSKVFKYNSSLIKHQIIHTGKRP

SEQ ID NO: 16395 - protein, 723 aa, Homo Sapiens
MSLLKERKPKKPHYIPRPPGKPFKYKCFQCPFTCNEKSHLFNHMKYGLCKNSITLVSEQDRVPKCPKSNSLDPKQTNQPDATAKPASSKSVANGLSAFDSKLQHSSAREDIKENLELQARGTHRCLGQKPALHRASPCKSPAPEAALGAQPALEGAARPSAFVPVGEHRLKGPDNAEAPETLALHNPTAKAVSFHTKSAFHTPGYPWKAGSPFLPPEFPHKISSTKGLGAISPYMHPTIPEYPPHFYTEHGLATIYSPYLLAGSSPECDAPLLSVYGTQDPRHFLPHPGPIPKHLAPSPATYDHYRFFQQYPSNLPIPYGFYRPESAFSSYGLRLPPVTGLTRDQSSHLLEEATLVYPASSPSRLNPSDPNRKHVEFESPIPEAKDSSKAGQRDTEGSKMSPRAGSAATGSPGRPSPTDFMQTSQTCEGLYDLSNKAASSALGRLYPPEQSLTAFRPVKKSTECLPAQAAETTAESPVSLNVVNGDPPAPTGSASLVSEAAPSSPDDSSGMGPLNLSKKSEINLAATHEPTYQGSPQAETASFSELQDLPLNLSVKDPCNTQAPRPAFPGRPRAAEPAAAVPQKTGTEGSEDGPSHPETKPGSLDGDGAPPTGPGEEAPDACAVDSSEEQKQTAAVALCQLAAYSPRNIRVGDGDAAAPEPACRQDTPTLSSMESQEAQCDLRPKGQKRTSLRDAGKSQQGAKKAKLQDTARVFTLRRRARVS

SEQ ID NO: 16396 - protein, 296 aa, Homo Sapiens
MYFSQEEWELLDPTQKALYNDVMQENYETVISLALFVLPKPKVISCLEQGEEPWVQVSPEFKDSAGKSPTGLKLKNDTENHQPVSLSDLEIQASAGVISKKAKVKVPQKTAGKENHFDMHRVGKWHQDFPVKKRKKLSTWKQELLKLMDRHKKDCAREKPFKCQECGKTFRVSSDLIKHQRIHTEEKPYKCQQCDKRFRWSSDLNKHLTTHQGIKPYKCSWCGKSFSQNTNLHTHQRTHTGEKPFTCHECGKKFSQNSHLIKHRRTHTGEQPYTCSICRRNFSRRSSLLRHQKLHL

SEQ ID NO: 16397 - protein, 510 aa, Homo Sapiens
MAMRELNADSCSSPQMGAMWETSGSVKENSSQSKKYSTKIENLGPESACRHFWSFRYHEATGPLETISQLQKLCHQWLRPEIHSKEQILEMLVLEQFLSILPKETQNWVQKHHPQNVKQALVLVEFLQREPDGTKNEVTAHELGKEAVLLGGTAVAPGFKWKPAEPQPMGVFQKEYWNTYRVLQEQLGWNTHKETQPVYERAVHDQQMLALSEQKRIKHWKMASKLILPESLSLLTFEDVAVYFSEEEWQLLNPLEKTLYNDVMQDIYETVISLGLKLKNDTGNDHPISVSTSEIQTSGCEVSKKTRMKIAQKTMGRENPGDTHSVQKWHRAFPRKKRKKPATCKQELPKLMDLHGKGPTGEKPFKCQECGKSFRVSSDLIKHHRIHTGEKPYKCQQCDRRFRWSSDLNKHFMTHQGIKPYRCSWCGKSFSHNTNLHTHQRIHTGEKPFKCDECGKRFIQNSHLIKHQRTHTGEQPYTCSLCKRNFSRRSSLLRHQKLHRRREACLVSPN

SEQ ID NO: 16398 - protein, 570 aa, Homo Sapiens
MESLGLHTVTLSDGTTAYVQQAVKGEKLLEGQVIQLEDGTTAYIHQVTVQKEALSFEDGQPVQLEDGSMAYIHRTPREGYDPSTLEAVQLEDGSTAYIHHPVAVPSESTILAVQTEVGLEDLAAEDDEGFSADAVVALEQYASKVLHDSQIPRNGKGQQVGDRAFRCGYKGCGRLYTTAHHLKVHERAHTGDRPYRCDFPSCGKAFATGYGLKSHVRTHTGEKPYKCPEELCSKAFKTSGDLQKHVRTHTGERPFQCPFEGCGRSFTTSNIRKVHVRTHTGERPYTCPEPHCGRGFTSATNYKNHVRIHTGEKPYVCTVPGCGKRFTEYSSLYKHHVVHTHCKPYTCSTCGKTYRQTSTLAMHKRSAHGELEATEESEQALYEQQQLEAASAAEESPPPKRPRIAYLSEVKEERDDIPAQVAMVTEEDGAPQVALITQDGAQQVSLSPEDLQALGSAISMVTQHGSTTLTIPSPDADLATSGTHTVTMVSADGTQTQPVTIITSGAVVAEDSSVASLRHQQVALLATANGTHIAVQLEEQQTLEEAINVATAAMQQGAVTLETTVSESGC

SEQ ID NO: 16399 - protein, 746 aa, Homo Sapiens
MAFSQGLLTFRDVAIEFSQEEWKCLDPAQRTLYRDVMLENYRNLVSLDISSKCTMKEFLSTAQGNREVFHAGTLQIHESHHNGDFCYQDVDKDIHDYEFQWQEDERNGHEAPMTKIKKLTGITERYDQSHARNKPIKDQLGSSFHSHLPEMHIFQTEEKIDNQVVKSVHDASLVSTAQRISCRPKTHISNNHGNNFWNSSLLTQKQEVHMREKSFQCNESGKAFNYSSLLRKHQIIHLADKYKCDVCGKLFNQKRNLACHRRCHTGENPYKCNECGKTFSQTSSLTCHRRLHTGEKPYKCEECDKAFHFKSILERHRIIHTEEKPYKCNECGKTFRQKSILTRHHRLHTGEKPYKCNECGKTFSHKSSLTCHHRLHTGEKPYKCNECGKTFSHKSSLTCHRRLHTGEKPYKCEECDKAYSFRSNFEIHRKIHTEDNAYKCNECGKTFSRTSSLTCHRRRHTGEQPYKCEECDKAFRFKSNLERHRRIHTGEKPYKCNECGKTFSRKSYLTCHHRLHTGEKAYKCNECGKTFSWKSSLTCHRRLHSGEKPYKCKECGKTFNQQLTLKRHRRLHSGENPYKCEDSDKAYSFKSNLEIHQKIHTEENPYKCNECGKTFSRTSSLTCHRRLHTGEKPYKCEECDKAFRVKSNLEGHRRIHTGEKPYKCNECGKTFSRKSYFICHHRLHTGEKPYKCNECGKNFSQKSSLICHHRLHTGEKPYKCNECGKTFSQKSNLTCHRRLHTGEKQV

SEQ ID NO: 16400 - protein, 394 aa, Homo Sapiens
MDPVACEDVAVNFTQEEWALLDISQRKLYREVMLETFRNLTSIGKKWKDQNIEYEYQNPRRNFRSLIEGNVNEIKEDSHCGETFTQVPDDRLNFQEKKASPEAKSCDNFVCGEVGIGNSSFNMNIRGDIGHKAYEYQDYAPKPYKCQQPKKAFRYHPSFRTQERNHTGEKPYACKECGKTFISHSGIRRRMVMHSGDGPYKCKFCGKAVHCLRLYLIHERTHTGEKPYECKQCVKSFSYSATHRIHERTHTGEKPYECQQCGKAFHSSSSFQAHKRTHTGGKPYECKQCGKSFSWCHSFQIHERTHTGEKPCECSKCNKAFRSYRSYLRHKRSHTGEKPYQCKECRKAFTYPSSLRRHERTHSAKKPYECKQCGKALSYKFSNTPKNALWRKTL

SEQ ID NO: 16401 - protein, 408 aa, Homo Sapiens
MAPPLAPLPPRDPNGAGPEWREPGAVSFADVAVYFCREEWGCLRPAQRALYRDVMRETYGHLSALGIGGNKPALISWVEEEAELWGPAAQDPEVAKCQTQTDPADSRNKKKERQREGTGALEKPDPVAAGSPGLKSPQAPSAGPPYGWEQLSKAPHRGRPSLCAHPPVPRADQRHGCYVCGKSFAWRSTLVEHVYSHTGEKPFHCTDCGKGFGHASSLSKHRAIHRGERPHRCLECGRAFTQRSALTSHLRVHTGEKPYGCADCGRRFSQSSALYQHRRVHSGETPFPCPDCGRAFAYPSDLRRHVRTHTGEKPYPCPDCGRCFRQSSEMAAHRRTHSGEKPYPCPQCGRRFGQKSAVAKHQWVHRPGAGGHRGRVAGRLSVTLTPGHGDLDPPVGFQLYPEIFQECG

SEQ ID NO: 16402 - protein, 523 aa, Homo Sapiens
MALPQGLLTFRDVAIEFSQEEWKCLDPAQRTLYRDVMLENYRNLVSLDISSKCMMKEFSSTAQGNREVFHAGTSQRHESHHNGDFCFQDIDKDIHDIEFQWQEDERNGHEALMTKIKKLTGSTERYDQNYAGNKPVKYQLGFSFHSHLPELHIFHTEEKIDNQVVKSIHDASLVSTAQRISCRPETHISNDYGNNFLNSSLFTQKQEVHMREKSFQCNDSGKAYNCSSLLRKHQLIHLGEKQYKCDICGKVFNSKRYVARHRRCHTGEKPYKCNECGKTFSQTYYLTCHRRLHTGEKPYKCEECDKAFHFKSKLQIHRRIHTGEKPYKCNECGKTFSQKSYLTCHRRLHTGEKPYKCNECGKTFSRKSHFTCHHRVHTGEKPYKCNECSKTFSHKSSLTYHRRLHTEEKPYKCNECGKTFNQQLTLNICRLHSGEKPYKCEECDKAYSFKSNLEIHQKIHTEENPYKCNECGKTFSRTSSLTYHHRLHTGQKPYKCEDCDEAFSFKSNLERHRRIYTGEKLHV

SEQ ID NO: 16403 - protein, 468 aa, Homo Sapiens
MAQLRRGHLTFRDVAIEFSQEEWKCLDPVQKALYRDVMLENYRNLVSLGICLPDLSIISMMKQRTEPWTVENEMKVAKNPDRWEGIKDINTGRSCAVRSKAGNKPITNQLGLTFQLPLPELEIFQGEGKIYECNQVQKFISHSSSVSPLQRIYSGVKTHIFNKHRNDFVDFPLLSQEQKAHIRRKPYECNEQGKVFRVSSSLPNHQVIHTADKPNRCHECGKTVRDKSGLAEHWRIRTGEKPYKCKECGKLFNRIAYLARHEKVHTGESPYKCNECGKVFSRITYLVRHQKIHTREKPHKCNKCGKVYSSSSYLAQHWRIHTGEKLYKCNKCGKEFSGHSSLTTHLLIHTGEKPYKCKECDKAFRHKFSLTVHQRNHNGEKPYKCHECGKVFTQVSHLARHQKIHTGEKPYKCNECGKVFTQNSHLANHQRIHTGEKPYKCHVCGKVFRHSSWFVQHQRSVHERVLTN

SEQ ID NO: 16404 - protein, 540 aa, Homo Sapiens
MEREALPWGLEPQDVQSSDEMRSPEGYLRGNMSENEEEEISQQEGSGDYEVEEIPFGLEPQSPGFEPQSPEFEPQSPRFEPESPGFESRSPGLVPPSPEFAPRSPESDSQSPEFESQSPRYEPQSPGYEPRSPGYEPRSPGYESESSRYESQNTELKTQSPEFEAQSSKFQEGAEMLLNPEEKSPLNISVGVHPLDSFTQGFGEQPTGDLPIGPPFEMPTGALLSTPQFEMLQNPLGLTGALRGPGRRGGRARGGQGPRPNICGICGKSFGRGSTLIQHQRIHTGEKPYKCEVCSKAFSQSSDLIKHQRTHTGERPYKCPRCGKAFADSSYLLRHQRTHSGQKPYKCPHCGKAFGDSSYLLRHQRTHSHERPYSCTECGKCYSQNSSLRSHQRVHTGQRPFSCGICGKSFSQRSALIPHARSHAREKPFKCPECGKRFGQSSVLAIHARTHLPGRTYSCPDCGKTFNRSSTLIQHQRSHTGERPYRCAVCGKGFCRSSTLLQHHRVHSGERPYKCDDCGKAFSQSSDLIRHQRTHAAGRR

SEQ ID NO: 16405 - protein, 545 aa, Homo Sapiens
MDCVIFEEVAVNFTPEEWALLDHAQRSLYRDVMLETCRNLASLDCYIYVRTSGSSSQRDVFGNGISNDEEIVKFTGSDSWSIFGENWRFDNTGDQHQIPQRHLRSQLGRLCESNEGHQCGETLSQTANLLVHKSYPTEAKPSECTKCGKAFENRQRSHTGQRPCKECGQACSCLSCQSPPMKTQTVEKPCNCQDSRTASVTYVKSLSSKKSYECQKCGKAFICPSSFRGHVNSHHGQKTHACKVCGKTFMYYSYLTRHVRTHTGEKPYECKECGKAFSCPSYFREHVRTHTGEKPYECKHCGKSFSCYSSFRDHVRTHTGEKPCQCKHCGKAFTCYSSLREHGRTHSGEKPYECKECGKAFRYPSSLRAHMRMHTGEKPYVCKQCGKAFGCPTYFRRHVKTHSGVKPYQCKECGKAYSFSSSLRIHVRTHTGEKPFECKHCGKAFSCHSSLREHVRTHSGEKPYECNQCGKAFSHAQYFQKHVRSHSGVKPYECTECGKAYSCSSSLRVHVRTHTGERPYECKQCGKTFRYLASLQAHVRTHAGA

SEQ ID NO: 16406 - protein, 691 aa, Homo Sapiens
MMAENNLKMLKIQQCVVANKLPRNRPYVCNICFKHFETPSKLARHYLIHTGQKPFECDVCHKTFRQLVHLERHQLTHSLPFKCSICQRHFKNLKTFVKHQQLHNETYQNNVKQVRRLLEAKQEKSMYGVYNTFTTEERWALHPCSKSDPMYSMKRRKNIHACTICGKMFPSQSKLDRHVLIHTGQRPFKCVLCTKSFRQSTHLKIHQLTHSEERPFQCCFCQKGFKIQSKLLKHKQIHTRNKAFRALLLKKRRTESRPLPNKLNANQGGFENGEIGESEENNPLDVHSIYIVPFQCPKCEKCFESEQILNEHSCFAARSGKIPSRFKRSYNYKTIVKKILAKLKRARSKKLDNFQSEKKVFKKSFLRNCDLISGEQSSEQTQRTFVGSLGKHGTYKTIGNRKKKTLTLPFSWQNMGKNLKGILTTENILSIDNSVNKKDLSICGSSGEEFFNNCEVLQCGFSVPRENIRTRHKICPCDKCEKVFPSISKLKRHYLIHTGQRPFGCNICGKSFRQSAHLKRHEQTHNEKSPYASLCQVEFGNFNNLSNHSGNNVNYNASQQCQAPGVQKYEVSESDQMSGVKAESQDFIPGSTGQPCLPNVLLESEQSNPFCSYSEHQEKNDVFLYRCSVCAKSFRSPSKLERHYLIHAGQKPFECSVCGKTFRQAPHWKRHQLTHFKERPQGKVVALDSVM

SEQ ID NO: 16407 - protein, 317 aa, Homo Sapiens
MPGEQQAEEEEEEEMQEEMVLLVKGEEDEGEEKYEVVKLKIPMDNKEVPGEAPAPSADPARPHACPDCGRAFARRSTLAKHARTHTGERPFGCTECGRRFSQKSALTKHGRTHTGERPYECPECDKRFSAASNLRQHRRRHTGEKPYACAHCGRRFAQSSNYAQHLRVHTGEKPYACPDCGRAFGGSSCLARHRRTHTGERPYACADCGTRFAQSSALAKHRRVHTGEKPHRCAVCGRRFGHRSNLAEHARTHTGERPYPCAECGRRFRLSSHFIRHRRAHMRRRLYICAGCGRDFKLPPGATAATATERCPECEGS

SEQ ID NO: 16408 - protein, 489 aa, Homo Sapiens
MAAAEPMGPAQVPMNSEVIVDPIQGQVNFEDVFVYFSQEEWVLLDEAQRLLYRDVMLENFALMASLGHTSFMSHIVASLVMGSEPWVPDWVDMTLAVATETPGGSDPGCWHGMEDEEIPFEQSFSIGMSQIRIPKGGPSTQKAYPCGTCGLVLKDILHLAEHQETHPGQKPYMCVLCGKQFCFSANLHQHQKQHSGEKPFRSDKSRPFLLNNCAVQSMEMSFVTGEACKDFLASSSIFEHHAPHNEWKPHSNTKCEEASHCGKRHYKCSECGKTFSRKDSLVQHQRVHTGERPYECGECGKTFSRKPILAQHQRIHTGEMPYECGICGKVFNHSSNLIVHQRVHTGARPYKCSECGKAYSHKSTLVQHESIHTGERPYECSECGKYFGHKYRLIKHWSVHTGARPYECIACGKFFSQSSDLIAHQRVHNGEKPYVCSECGKAFSHKHVLVQHHRIHTGERPYKCSECGKAFRQRASLIRHWKIHTGERP

SEQ ID NO: 16409 - protein, 442 aa, Homo Sapiens
MAAATLRDPAQQGYVTFEDVAVYFSQEEWRLLDDAQRLLYRNVMLENFTLLASLGLASSKTHEITQLESWEEPFMPAWEVVTSAILRGSWQGAKAEAAAEQSASVEVPSSNVQQHQKQHCGEKPLKRQEGRVPVLRSCRVHLSEKSLQSREVGKDLLTSSGVLKHQVTHTGEKSHRSSKSREAFHAGKRHYKCSECGKAFGQKYLLVQHQRLHTGEKPYECSECGKLFSHKSNLFIHQIVHTGERPYGCSDCGKSFSRNADLIQHQRVHTGEKPFTCSECGKAFRHNSTLVQHHRIHTGVRPYECSECGKLFSFNSSLMKHQRVHTGERPYKCSECGKFYSHKSSLINHWRVHTGERPYECSECGKFFSQSSSLMQHRKVHTGEKPFKCNECGRFFSENSSLVKHQRVHTGAKPYECRECGKFFRHSSSLVKHRRIHTGEIQ

SEQ ID NO: 16410 - protein, 483 aa, Homo Sapiens
MWLGTSGKSGLPGHCLENPLQECHPAQLEEWALKGISRPSVISQPEQKEEPWVLPLQNFEARKIPRESHTDCEHQVAKLNQDNSETAEQCGTSSERTNKDLSHTLSWGGNWEQGLELEGQHGTLPGEGQLESFSQERDLNKLLDGYVGEKPMCAECGKSFNQSSYLIRHLRTHTGERPYTCIECGKGFKQSSDLVTHRRTHTGEKPYQCKGCEKKFSDSSTLIKHQRTHTGERPYECPECGKTFGRKPHLIMHQRTHTGEKPYACLECHKSFSRSSNFITHQRTHTGVKPYRCNDCGESFSQSSDLIKHQRTHTGERPFKCPECGKGFRDSSHFVAHMSTHSGERPFSCPDCHKSFSQSSHLVTHQRTHTGERPFKCENCGKGFADSSALIKHQRIHTGERPYKCGECGKSFNQSSHFITHQRIHLGDRPYRCPECGKTFNQRSHFLTHQRTHTGEKPFHCSKCNKSFRQKAHLLCHQNTHLI

SEQ ID NO: 16411 - protein, 537 aa, Homo Sapiens
MESGLAGNGTGAGLVMKVKQEKPERLLQTLAPQAMLVEKDKENIFQQHRGLPPRQTMGRPRALGGQEESGSPRWAPPTEQDAGLAGRAPGSASGPLSPSLSSGEGHFVCLDCGKRFSWWSSLKIHQRTHTGEKPYLCGKCGKSFSQKPNLARHQRHHTGERPFCCPECARRFSQKQHLLKHQKTHSRPATHSCPECERCFRHQVGLRIHQRAHARDRQGSRAGLHELIQDAAARRACRLQPGPPRGRPEWAWLGLCQGWWGQPGARAAVSGPEGPGEPRQFICNECGKSFTWWSSLNIHQRIHTGERPYACPECGRRFSQKPNLTRHLRNHTGERPHPCPHCGRGFRQKQHLLKHLRTHLPGAQAAPCPSCGKSCRSRAALRAHQRAHAVAEPAVPAGEPGDQPQAEAIPGLAARPRSSQRSPGARDTLWGRGQAGLAGPGEPRQFICNECGKSFSWWSALTIHQRIHTGERPYPCPECGRRFSQKPNLTRHRRNHTGERPYLCPACGRGFSQKQHLLKHQRVHRAAPACSPKEEAR

SEQ ID NO: 16412 - protein, 518 aa, Homo Sapiens
MAAAALRPPAQGTVTFEDVAVNFSQEEWSLLSEAQRCLYHDVMLENLTLISSLGCWYGAKDETPSKQTLSIQQESPLRTHWTGVCTKKVHLWGMCGPLLGDILHQGTQHNQKLNGFGAYEKKLDDDANHHQDQKQHIGEKSYRSNAKGTSFVKNCKFHMSHEPFIFHEVGKDFLSSLRLLQQEDIHTSGKSNFETKHGIPLQGGKTHYICGESTIPFSNKHSLVLHQRLLPREGPYVCSDSGKFTSKSNSFNNHQGVRTGKRPYQCGQCDESFWYKAHLTEHQRVHTGERPYECGECDKSFSHKHSLVDHQRVHTGERPYECDECGKSFSHKRSLVHHQRVHTGERPYQCGECGKSFNHKCNLIQHQRVHTGERPFECTACGKLFRSNSHLKEHQRVHTGERPYECKECRKSFRYKSHLTEHQRVHTGERPYECRECGKCFHQKGSLIQHQQIHSGERPHECGECGKCFHQKGSLIRHQQIHSGERPHECGECGKCFRQKGNLIKHQRVHTGERHHEC

SEQ ID NO: 16413 - protein, 760 aa, Homo Sapiens
MENQRSSPLSFPSVPQEETLRQAPAGLPRETLFQSRVLPPKEIPSLSPTIPRQGSLPQTSSAPKQETSGRMPHVLQKGPSLLCSAASEQETSLQGPLASQEGTQYPPPAAAEQEVSLLSHSPHHQEAPVHSPEAPEKDPLTLSPTVPETDMDPLLQSPVSQKDTPFQISSAVQKEQPLPTAEITRLAVWAAVQAVERKLEAQAMRLLTLEGRTGTNEKKIADCEKTAVEFANHLESKWVVLGTLLQEYGLLQRRLENMENLLKNRNFWILRLPPGSNGEVPKVPVTFDDVAVHFSEQEWGNLSEWQKELYKNVMRGNYESLVSMDYAISKPDLMSQMERGERPTMQEQEDSEEGETPTDPSAAHDGIVIKIEVQTNDEGSESLETPEPLMGQVEEHGFQDSELGDPCGEQPDLDMQEPENTLEESTEGSSEFSELKQMLVQQRNCTEGIVIKTEEQDEEEEEEEEDELPQHLQSLGQLSGRYEASMYQTPLPGEMSPEGEESPPPLQLGNPAVKRLAPSVHGERHLSENRGASSQQQRNRRGERPFTCMECGKSFRLKINLIIHQRNHIKEGPYECAECEISFRHKQQLTLHQRIHRVRGGCVSPERGPTFNPKHALKPRPKSPSSGSGGGGPKPYKCPECDSSFSHKSSLTKHQITHTGERPYTCPECKKSFRLHISLVIHQRVHAGKHEVSFICSLCGKSFSRPSHLLRHQRTHTGERPFKCPECEKSFSEKSKLTNHCRVHSRERPPPRWSSSFCSL

SEQ ID NO: 16414 - protein, 729 aa, Homo Sapiens
MAAPDLAHGGHVSRDSVCLHEEQTQAAGMVAGWLINCYQDAVTFDDVAVDFTQEEWTLLDPSQRDLYRDVMLENYENLASVEWRLKTKGPALRQDRSWFRASNETQTARSHNGGQLCDRTQCGEAFSEHSGLSTHVRTQNTGDSCVSNHYERDFFIPCQKTLFKIGEQFSVLGQCGKAFSSTPNVVSQQACTRDRSLDYSSCGEVFLNQSYLQARAGSHNGEETWKWKPCGKALTHSMGCATPVEMHAVRNPHVCRECGKAFRYTAYLTGRVQVHPGEKPCELEECGKASPVSSSLTQHVRIHAAEKPCECKECGKAFTGLSGLSKHVQTDPGQKPYECKDCGKACGGFYLLNEHGKTHTREKPFACVVCGKYFRNSSCLNNHVRIHTGIKPYTCSYCGKAFTVRCGLTRHVRTHTGEKPYTCKDCGKAFCTSSGLTEHVRTHTGEKPYECKDCGKSFTVSSSLTEHARIHTGEKPYECKQCGKAFTGRSGLTKHMRTHTGEKPYECKDCGKAYNRVYLLNEHVKTHTEEKPFICTVCRKSFRNSSCLNKHIQIHTGIKPYECKDCGKTFTVSSSLTEHIRTHTGEKPYECKVCGKAFTTSSHLIVHIRTHTGEKPYICKECGKAFASSSHLIEHRRTHTGEKPYICNECGKAFRASSHLHKHGRIHTGQKPYKCKECGKAYNRFYLLKEHLKTYTEEQVFVCKDCGKSFKNSSCLNHHTQIHTDEKPF

SEQ ID NO: 16415 - protein, 641 aa, Homo Sapiens
MVHGSVTFRDVAIDFSQEEWECLQPDQRTLYRDVMLENYSHLISLGSSISKPDVITLLEQEKEPWMVVRKETSRRYPDLELKYGPEKVSPENDTSEVNLPKQVIKQISTTLGIEAFYFRNDSEYRQFEGLQGYQEGNINQKMISYEKLPTHTPHASLICNTHKPYECKECGKYFSRSANLIQHQSIHTGEKPFECKECGKAFRLHIQFTRHQKFHTGEKPFECNECGKAFSLLTLLNRHKNIHTGEKLFECKECGKSFNRSSNLVQHQSIHSGVKPYECKECGKGFNRGAHLIQHQKIHSNEKPFVCKECGMAFRYHYQLIEHCQIHTGEKPFECKECGKAFTLLTKLVRHQKIHTGEKPFECRECGKAFSLLNQLNRHKNIHTGEKPFECKECGKSFNRSSNLVQHQSIHAGIKPYECKECGKGFNRGAHLIQHQKIHSNEKPFVCRECEMAFRYHCQLIEHSRIHTGDKPFECQDCGKAFNRGSSLVQHQSIHTGEKPYECKECGKAFRLYLQLSQHQKTHTGEKPFECKECGKFFRRGSNLNQHRSIHTGKKPFECKECGKAFRLHMHLIRHQKLHTGEKPFECKECGKAFRLHMQLIRHQKLHTGEKPFECKECGKVFSLPTQLNRHKNIHTGEKAS

SEQ ID NO: 16416 - protein, 833 aa, Homo Sapiens
MVHGSVTFRDVAIDFSQEEWECLQPDQRTLYRDVMLENYSHLISLGSSISKPDVITLLEQEKEPWIVVSKETSRWYPDLESKYGPEKISPENDIFEINLPKHVIKQISKTLGLEAFYFRNDSEYRSRFEGRQGHQEGYINQKIISYEEMPAYTHASPIHNTHKPYECKECGKYFSCGSNLIQHQSIHTGEKPYKCKECGKAFQLHIQLTRHQKFHTGEKTFECKECGKAFNLPTQLNRHKNIHTVKKLFECKECGKSFNRSSNLTQHQSIHAGVKPYQCKECGKAFNRGSNLIQHQKIHSNEKPFVCRECEMAFRYHYQLIEHCRIHTGEKPFECKECRKAFTLLTKLVRHQKIHMGEKPFECRECGKAFSLLNQLNRHKNIHTGEKPFECKECGKSFNRSSNLIQHQSIHADVKPYECKECGKGFNRGANLIQHQKIHSNEKPFVCRECEMAFRYHYQLIQHCQIHTGGKPFECKECGKAFSLLTQLARHKNIHTGEKPFECKDCGKAFNRGSNLVQHQSIHTGEKPYECKECGKAFRLHLQLSQHEKTHTGEKPFECKECGKFFRRGSNLNQHRSIHTGKKPFECKECGKAFRLHMHLIRHQKFHTGEKPFECKECGKAFSLHTQLNHHKNIHTGEKPFKCKECGKSFNRVSNLVQHQSIHAGVKPYECKECGKGFSRVSNLIQHQKTHSSAKPFVCKECRKTFRYHYQLTEHYRIHTGEKPFECKECGKAFGLLTQLAQHQIIHTGEKPFKCKECGKAFNRGSNLVQPQSIHTGEKPYECKECGKAFRLHLQLSLHQKLVQVRNPLNVRNVGQPSDISSNLLNIRKFILG

SEQ ID NO: 16417 - protein, 355 aa, Homo Sapiens
MQRNAMYLKNVAETACNFQLTQYQISHANQKPYECQICGKPFRKRAHLTQHNRIHTGGKPYECKECGKVFICCSTLIQHKRTHTSEKPYECLECRKTFRRSAHLIRHQRIHTGEKPYKCKQCWKAFASVSDLIDIGKFTLMRDFTNVQNVGRHLTIAQLLFSIREFTLVRSPLNVRNVAKHSIIAQHLLNTRELILMRNLMNVRNVKRLLGKVHILLNIKEFILVRNHMSVSNVGRLSLVFLILIDIREFTLVKNPMNVKNVVELLTIVQLLFNTREFTLVRRLMNISSVGRFLSPVQHLFNIREHILMKNLMNVSNARRPSSIMHILFDIKEFILVRNLINVSNVGRPLLLFLI

SEQ ID NO: 16418 - protein, 699 aa, Homo Sapiens
MNTFQASVSFQDVTVEFSQEEWQHMGPVERTLYRDVMLENYSHLVSVGYCFTKPELIFTLEQGEDPWLLEKEKGFLSRNSPEDSQPDEISEKSPENQGKHLLQVLFTNKLLTTEQEISGKPHNRDINIFRARMMPCKCDIAGSACQGLSLMAPHCQYSKEKAHERNVCDKWLISIKDGRTNTQEKSFAYSKIVKTLHHKEEVIQHQTIQTLGQDFEYNESRKAFLEKAALVTSNSTHPKGKSYNFNKFGENKYDKSTFIIPQNMNPEKSHYEFNDTGNCFCRITHKTLTGGKSFSQKSHIREHHRVHIGVKPFEYGKSFNRNSTLPVHQRTHATDKYSDYHPCTETFSYQSTFSVHQKVHIRAKPYEYNECGKSCSMNSHLIWPQKSHTGEKPYECPECGKAFSEKSRLRKHQRTHTGEKPYKCDGCDKAFSAKSGLRIHQRTHTGEKPFECHECGKSFNYKSILIVHQRTHTGEKPFECNECGKSFSHMSGLRNHRRTHTGERPYKCDECGKAFKLKSGLRKHHRTHTGEKPYKCNQCGKAFGQKSQLRGHHRIHTGEKPYKCNHCGEAFSQKSNLRVHHRTHTGEKPYQCEECGKTFRQKSNLRGHQRTHTGEKPYECNECGKAFSEKSVLRKHQRTHTGEKPYNCNQCGEAFSQKSNLRVHQRTHTGEKPYKCDKCGRTFSQKSSLREHQKAHPGD

SEQ ID NO: 16419 - protein, 281 aa, Homo Sapiens
MAEAAPARDPETDKHTEDQSPSTPLPQPAAEKNSYLYSTEITLWTVVAAIQALEKKVDSCLTRLLTLEGRTGTAEKKLADCEKTAVEFGNQLEGKWAVLGTLLQEYGLLQRRLENVENLLRNRNFWILRLPPGSKGEAPKVPVTFDDVAVYFSELEWGKLEDWQKELYKHVMRGNYETLVSLDYAISKPDILTRIERGEEPCLDRWGQEKGNEVEVGRPRMMGTGLPPYPEHLTSPLSPAQEELKEGQAPKQQQDSEARVAPAGPEAGLALRTDLQGEAQI

SEQ ID NO: 16420 - protein, 323 aa, Homo Sapiens
MAAARPEAQSRSSPTPESRSQEPLDLVLVPDDCRPGTPPSDLIEIQVVKVTDTTLVPEPPEPGSFHCALCPAAFRLVSELLFHEHGHLAGAEGGGQGGDPSRCHVCGHSCPGPASLRAHYSLHTGERPYRCALCPRAFKALAPLLRHQHRHGVEPGTSRRPPDTAAVAEQRPGVAPERAEVVMAAAAAGAAVGKPFACRFCAKPFRRSSDMRDHERVHTGERPYHCGICGKGFTQSSVLSGHARIHTGERPFRCTLCDRTFNNSSNFRKHQRTHFHGPGPGLGDSGGQLGSSAAEGSGSGCGVGDPAEEGRGETAKVKVEADQ

SEQ ID NO: 16421 - protein, 405 aa, Homo Sapiens
MGPPLAPRPAHVPGEAGPRRTRESRPGAVSFADVAVYFSPEEWECLRPAQRALYRDVMRETFGHLGALGFSVPKPAFISWVEGEVEAWSPEAQDPDGESSAAFSRGQGQEAGSRDGNEEKERLKKCPKQKEVAHEVAVKEWWPSVACPEFCNPRQSPMNPWLKDTLTRRLPHSCPDCGRNFSYPSLLASHQRVHSGERPFSCGQCQARFSQRRYLLQHQFIHTGEKPYPCPDCGRRFRQRGSLAIHRRAHTGEKPYACSDCKSRFTYPYLLAIHQRKHTGEKPYSCPDCSLRFAYTSLLAIHRRIHTGEKPYPCPDCGRRFTYSSLLLSHRRIHSDSRPFPCVECGKGFKRKTALEAHRWIHRSCSERRAWQQAVVGRSEPIPVLGGKDPPVHFRHFPDIFQECG

SEQ ID NO: 16422 - protein, 782 aa, Homo Sapiens
MAEPPRLPLTFEDVAIYFSEQEWQDLEAWQKELYKHVMRSNYETLVSLDDGLPKPELISWIEHGGEPFRKWRESQKSGNIICSSVDMHFDPGFEEQLFWGSQQAMNSGKTKSHFQLDPESQCSFGSFVSFRPDQGITLGSPQRHDARAPPPLACGPSESTLKEGIPGPRNLDLPGLWDVPAWESTQHPWPVCGESCWENNHLVMHQRGHSKDRTRRAWEKFNKRAETQMPWSSPRVQRHFRCGVCGKSFRRKLCLLRHLAAHTGRGPFRNADGEMCFRHELTHPSHRLPQQGEKPAQCTPCGKRSLPVDSTQARRCQHSREGPASWREGRGASSSVHSGQKPGSRLPQEGNSHQEGDTEALQHGAEGPCSCSECGERSPMSARLASPCRAHTGEKPFQCAHCTKRFRLRRLLQVHQHAHGGERPFSCRKCGKGFAKQCKLTEHIRVHSGEKPFRCAKCGRNFRQRGQLLRHQRLHTDEKPFQCPECGLSFRLESMLRAHRLRHGGERPFSCSECGRGFTHQCKLREHLRVHSGERPFQCLKCDKRFRLKGILKAHQHTHSKERPFSCGECGKGFTRQSKLTEHLRVHSGERPFQCPECNRSFRLKGQLLSHQRLHTGERPFQCPECDKRYRVKADMKAHQLLHSGEMPFSCECGKGFVKHSKLIEHIRTHTGEKPFQCPKCDKSFRLKAQLLSHQGLHTGERPFHCPECDKNFRERGHMLRHQRIHRPERPFACGDCGKGFIYKSKLAEHIRVHTKSCPAPNELDIKKRLSQLFAMIEADWS

SEQ ID NO: 16423 - protein, 382 aa, Homo Sapiens
MELREEAWSPGPLDSEDQQMASHENPVDILIMDDDDVPSWPPTKLSPPQSAPPAGPPPRPRPPAPYICNECGKSFSHWSKLTRHQRTHTGERPNACADCGKTFSQSSHLVQHRRIHTGEKPYACLECGKRFSWSSNLMQHQRIHTGEKPYTCPDCGRSFTQSKSLAKHRRSHSGLKPFVCPRCGRGFSQPKSLARHLRLHPELSGPGVAAKVLAASVRRAKGPEEAVAADGEIAIPVGDGEGIIVVGAPGEGAAAAAAMAGAGAKAAGPRSRRAPAPKPYVCLECGKGFGHGAGLLAHQRAQHGDGLGAAGGEEPAHICVECGEGFVQGAALRRHKKIHAVGAPSVCSSCGQSYYRAGGEEEDDDDEAAGGRCPECRGGEGR

SEQ ID NO: 16424 - protein, 82 aa, Homo Sapiens
MRNMIPQDNENPPQQGEANQNDSVAFEDVAVNFTPDEWALLDPSQKNLYREVMQETLRNLASIEVLWKRDSLKVKVISMEKF

SEQ ID NO: 16425 - protein, 425 aa, Homo Sapiens
MFPPARGKELLSFEDVAMYFTREEWGHLNWGQKDLYRDVMLENYRNMVLLGFQFPKPEMICQLENWDEQWILDLPRTGNRKASGSACPGSEARHKMKKLTPKQKFSEDLESYKISVVMQESAEKLSEKLHKCKEFVDSCRLTFPTSGDEYSRGFLQNLNLIQDQNAQTRWKQGRYDEDGKPFNQRSLLLGHERILTRAKSYECSECGKVIRRKAWFDQHQRIHFLENPFECKVCGQAFRQRSALTVHKQCHLQNKPYRCHDCGKCFRQLAYLVEHKRIHTKEKPYKCSKCEKTFSQNSTLIRHQVIHSGEKRHKCLECGKAFGRHSTLLCHQQIHSKPNTHKCSECGQSFGRNVDLIQHQRIHTKEEFFQCGECGKTFSFKRNLFRHQVIHTGSQPYQCVICGKSFKWHTSFIKHQGTHKGQIST

SEQ ID NO: 16426 - protein, 498 aa, Homo Sapiens
MLEEGVLPSPGPALPQEENTGEEGMAAGLLTAGPRGSTFFSSVTVAFAQERWRCLVSTPRDRFKEGIPGKSRSLVLLGLPVSQPGMNSQLEQREGAWMLEGEDLRSPSPGWKIISGSPPEQALSEASFQDPCVEMPPGDSDHGTSDLEKSFNLRPVLSPQQRVPVEARPRKCETHTESFKNSEILKPHRAKPYACNECGKAFSYCSSLSQHQKSHTGEKPYECSECGKAFSQSSSLIQHQRIHTGEKPYKCSECGRAFSQNANLTKHQRTHTGEKPYRCSECEKAFSDCSALVQHQRIHTGEKPYECSDCGKAFRHSANLTNHQRTHTGEKPYKCSECGKAFSYCAAFIQHQRIHTGEKPYRCAACGKAFSQSANLTNHQRTHTGEKPYKCSECGKAFSQSTNLIIHQKTHTGEKPYKCNECGKFFSESSALIRHHIIHTGEKPYECNECGKAFNQSSSLSQHQRIHTGVKPYECSECGKAFRCSSAFVRHQRLHAGE

SEQ ID NO: 16427 - protein, 636 aa, Homo Sapiens
MAHLMMFRDVAVDFSQEEWECLDLEQRDLYRDVMLENYSNMVSLGFCIYQPEAFSLLEKGKEPWKILRDETRGPCPDMQSRCQTKKLLPKNGIFEREIAQLEIMRICKNHSLDCLCFRGDWEGNTQFQTLQDNQEECFKQVIRTCEKRPTFNQHTVFNLHQRLNTGDKLNEFKELGKAFISGSDHTQHQLIHTSEKFCGDKECGNTFLPDSEVIQYQTVHTVKKTYECKECGKSFSLRSSLTGHKRIHTGEKPFKCKDCGKAFRFHSQLSVHKRIHTGEKSYECKECGKAFSCGSDLTRHQRIHTGEKPYECNECRKAFSQRSHLIKHQRIHTGEKPYECKECGKAFTRGSHLTQHQRIHTGEKSHECKECGKAFIRGSNLAQHQNVHVGRKPYKCEKCGKAYIWSSHLARHQRIHTGRKPYECKQCGKTFTWASYLAQHEKIHNERKSYECKECGKTFLHGSEFNRHQKIHTGERNYECKECGKTFFRGSELNRHQKIHTGKRPYECEECGKAFLWGSQLTRHQRMHTGEEPYVCKECGKSFIWGSQLTRHKKIHTDAEPYGCKKSSHIFSHHSYFTEQKIHNSANLCEWTDYGNTFSHESNFAQHQNIYTFEKSYEFKDFEKAFSSSSHFISLL

SEQ ID NO: 16428 - protein, 576 aa, Homo Sapiens
MDSVAFEDVSVSFSQEEWALLAPSQKKLYRDVMQETFKNLASIGEKWEDPNVEDQHKNQGRNLRSHTGERLCEGKEGSQCAENFSPNLSVTKKTAGVKPYECTICGKAFMRLSSLTRHMRSHTGYELFEKPYKCKECEKAFSYLKSFQRHERSHTGEKPYKCKQCGKTFIYHQPFQRHERTHIGEKPYECKQCGKALSCSSSLRVHERIHTGEKPYECKQCGKAFSCSSSIRVHERTHTGEKPYACKECGKAFISHTSVLTHMITHNGDRPYKCKECGKAFIFPSFLRVHERIHTGEKPYKCKQCGKAFRCSTSIQIHERIHTGEKPYKCKECGKSFSARPAFRVHVRVHTGEKPYKCKECGKAFSRISYFRIHERTHTGEKPYECKKCGKTFNYPLDLKIHKRNHTGEKPYECKECAKTFISLENFRRHMITHTGDGPYKCRDCGKVFIFPSALRTHERTHTGEKPYECKQCGKAFSCSSYIRIHKRTHTGEKPYECKECGKAFIYPTSFQGHMRMHTGEKPYKCKECGKAFSLHSSFQRHTRIHNYEKPLECKQCGKAFSVSTSLKKHMRMHNR

SEQ ID NO: 16429 - protein, 632 aa, Homo Sapiens
MAAAALRDPAQGCVTFEDVTIYFSQEEWVLLDEAQRLLYCDVMLENFALIASLGLISFRSHIVSQLEMGKEPWVPDSVDMTSAMARGAYGRPGSDFCHGTEGKDLPSEHNVSVEGVAQDRSPEATLCPQKTCPCDICGLRLKDILHLAEHQTTHPRQKPFVCEAYVKGSEFSANLPRKQVQQNVHNPIRTEEGQASPVKTCRDHTSDQLSTCREGGKDFVATAGFLQCEVTPSDGEPHEATEGVVDFHIALRHNKCCESGDAFNNKSTLVQHQRIHSRERPYECSKCGIFFTYAADLTQHQKVHNRGKPYECCECGKFFSQHSSLVKHRRVHTGESPHVCGDCGKFFSRSSNLIQHKRVHTGEKPYECSDCGKFFSQRSNLIHHKRVHTGRSAHECSECGKSFNCNSSLIKHWRVHTGERPYKCNECGKFFSHIASLIQHQIVHTGERPHGCGECGKAFSRSSDLMKHQRVHTGERPYECNECGKLFSQSSSLNSHRRLHTGERPYQCSECGKFFNQSSSLNNHRRLHTGERPYECSECGKTFRQRSNLRQHLKVHKPDRPYECSECGKAFNQRPTLIRHQKIHIRERSMENVLLPCSQHTPEISSENRPYQGAVNYKLKLVHPSTHPGEVP

SEQ ID NO: 16430 - protein, 406 aa, Homo Sapiens
MIEYQIPVSFKDVVVGFTQEEWHRLSPAQRALYRDVMLETYSNLVSVGYEGTKPDVILRLEQEEAPWIGEAACPGCHCWEDIWRVNIQRKRRQDMLLRPGAAISKKTLPKEKSCEYNKFGKISLLSTDLFSSIQSPSNWNPCGKNLNHNLDLIGFKRNCAKKQDECYAYGKLLQRINHGRRPNGEKPRGCSHCEKAFTQNPALMYKPAVSDSLLYKRKRVPPTEKPHVCSECGKAFCYKSEFIRHQRSHTGEKPYGCTDCGKAFSHKSTLIKHQRIHTGVRPFECFFCGKAFTQKSHRTEHQRTHTGERPFVCSECGKSFGEKSYLNVHRKMHTGERPYRCRECGKSFSQKSCLNKHWRTHTGEKPYGCNECGKAFYQKPNLSRHQKIHARKNAYRNENLIIVGNT

SEQ ID NO: 16431 - protein, 643 aa, Homo Sapiens
MASVALEDVAVNFTREEWALLGPCQKNLYKDVMQETIRNLDCVGMKWKDQNIEDQYRYPRKNLRCRMLERFVESKDGTQCGETSSQIQDSIVTKNTLPGVGPYESRMSGEVIMGHSSLNCYIRVGAGHKPYEYHECGEKPDTHKQRGKAFSYHNSLQTHERLHTGKKPYNCKECGKSFSSLGNLQRHMAVQRGDGPYKCKLCGKAFFWPSLLHMHERTHTGEKPYECKQCSKAFSFYSSYLRHERTHTGEKLYECKQCSKAFPDYSSCLRHERTHTGKKPYTCKQCGKAFSASTSLRRHETTHTDEKPYACQQCGKAFHHLGSFQRHMVMHTRDGPHKCKICGKGFDCPSSLKSHERTHTGEKLYECKQCGKALSHSSSFRRHMTMHTGDGPHKCKICGKAFVYPSVFQRHEKTHTAEKPYKCKQCGKAYRISSSLRRHETTHTGEKPYKCKCGKAFIDFYSFQNHKTTHAGEKPYECKECGKAFSCFQYLSQHRRTHTGEKPYECNTCKKAFSHFGNLKVHERIHSGEKPYECKECGKAFSWLTCFLRHERIHMREKPYECQQCGKAFTHSRFLQGHEKTHTGENPYECKECGKAFASLSSLHRHKKTHWKKTHTGENPYGCKECGKAFASLSSLHRHKKTH

SEQ ID NO: 16432 - protein, 575 aa, Homo Sapiens
MDPEDEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDKPYKCTDCGKSFNHNAHLTVHKRIHTGERPYMCKECGKAFSQNSSLVQHERIHTGDKPYKCAECGKSFCHSTHLTVHRRIHTGEKPYECQDCGRAFNQNSSLGRHKRTHTGEKPYTCSVCGKSFSRTTCLFLHLRTHTEERPYECNHCGKGFRHSSSLAQHQRKHAGEKPFECRQRLIFEQTPALTKHEWTEALGCDPPLSQDERTHRSDRPFKCNQCGKCFIQSSHLIRHQITHTREEQPHGRSRRREQSSSRNSHLVQHQHPNSRKSSAGGAKAGQPESRALALFDIQKIMQEKNPVHVIGVEEPSVGASMLFDIREST

SEQ ID NO: 16433 - protein, 273 aa, Homo Sapiens
MSPKRDGLGTGDGLHSQVLQEQVSTGDNLHECDSQGPSKDTLVREGKTYKCKECGSVFNKNSLLVRHQQIHTGVKPYECQECGKAFPEKVDFVRPMRIHTGEKPCKCVECGKVFNRRSHLLCYRQIHTGEKPYECSECGKTFSYHSVFIQHRVTHTGEKLFGCKECGKTFYYNSSLTRHMKIHTGEKPCKCSECGKTFTYRSVFFRHSMTHTAGKPYECKECGKGFYYSYSLTRHTRSHTGEKPYECLEHRKDFGYHSAFAQQSKIHSGGKNL

SEQ ID NO: 16434 - protein, 664 aa, Homo Sapiens
MPLRDKYCQTDHHHHGCCEPVYILEPGDPPLLQQPLQTSKSGIQQIIECFRSGTKQLKHILLKDVDTIFECKLCRSLFRGLPNLITHKKFYCPPSLQMDDNLPDVNDKQSQAINDLLEAIYPSVDKREYIIKLEPIETNQNAVFQYISRTDNPIEVTESSSTPEQTEVQIQETSTEQSKTVPVTDTEVETVEPPPVEIVTDEVAPTSDEQPQESQADLETSDNSDFGHQLICCLCRKEFNSRRGVRRHIRKVHKKKMEELKKYIETRKNPNQSSKGRSKNVLVPLSRSCPVCCKSFATKANVRRHFDEVHRGLRRDSITPDIATKPGQPLFLDSISPKKSFKTRKQKSSSKAEYNLTACKCLLCKRKYSSQIMLKRHMQIVHKITLSGTNSKREKGPNNTANSSEIKVKVEPADSVESSPPSITHSPQNELKGTNHSNEKKNTPAAQKNKVKQDSESPKSTSPSAAGGQQKTRKPKLSAGFDFKQLYCKLCKRQFTSKQNLTKHIELHTDGNNIYVKFYKCPLCTYETRRKRDVIRHITVVHKKSSRYLGKITASLEIRAIKKPIDFVLNKVAKRGPSRDEAKHSDSKHDGTSNSPSKKYEVADVGIEVKVTKNFSLHRCNKCGKAFAKKTYLEHHKKTHKANASNSPEGNKTKGRSTRSKALV

SEQ ID NO: 16435 - protein, 1209 aa, Homo Sapiens
MECYYIVISSTHLSNGHFRNIKGVFRGPLSKNGNKTLDYAEKENTIAKALEDLKANFYCELCDKQYYKHQEFDNHINSYDHAHKQRLKELKQREFARNVASKSRKDERKQEKALQRLHKLAELRKETVCAPGSGPMFKSTTVTVRENCNEISQRVVVDSVNNQQDFKYTLIHSEENTKDATTVAEDPESANNYTAKNNQVGDQAQGIHRHKIGFSFAFPKKASVKLESSAAAFSEYSDDASVGKGFSRKSRFVPSACHLQQSSPTDVLLSSEEKTNSFHPPEAMCRDKETVQTQEIKEVSSEKDALLLPSFCKFQLQLSSDADNCQNSVPLADQIPLESVVINEDIPVSGNSFELLGNKSTVLDMSNDCISVQATTEENVKHNEASTTEVENKNGPETLAPSNTEEVNITIHKKTNFCKRQCEPFVPVLNKHRSTVLQWPSEMLVYTTTKPSISYSCNPLCFDFKSTKVNNNLDKNKPDLKDLCSQQKQEDICMGPLSDYKDVSTEGLTDYEIGSSKNKCSQVTPLLADDILSSSCDSGKNENTGQRYKNISCKIRETEKYNFTKSQIKQDTLDEKYNKIRLKETHEYWFHKSRRKKKRKKLCQHHHMEKTKESETRCKMEAENSYTENAGKYLLEPISEKQYLAAEQLLDSHQLLDKRPKSESISLSDNEEMCKTWNTEYNTYDTISSKNHCKKNTILLNGQSNATMIHSGKHNLTYSRTYCCWKTKMSSCSQDHRSLVLQNDMKHMSQNQAVKRGYNSVMNESERFYRKRRQHSHSYSSDESLNRQNHLPEEFLRPPSTSVAPCKPKKKRRRKRGRFHPGFETLELKENTDYPVKDNSSLNPLDRLISEDKKEKMKPQEVAKIERNSEQTNQLRNKLSFHPNNLLPSETNGETEHLEMETTSGELSDVSNDPTTSVCVASAPTKEAIDNTLLEHKERSENINLNEKQIPFQVPNIERNFRQSQPKSYLCHYELAEALPQGKMNETPTEWLRYNSGILNTQPPLPFKEAHVSGHTFVTAEQILAPLALPEQALLIPLENHDKFKNVPCEVYQHILQPNMLANKVKFTFPPAALPPPSTPLQPLPLQQSLCSTSVTTIHHTVLQQHAAAAAAAAAAAAAGTFKVLQPHQQFLSQIPALTRTSLPQLSVGPVGPRLCPGNQPTFVAPPQMPIIPASVLHPSHLAFPSLPHALFPSLLSPHPTVIPLQPLF

SEQ ID NO: 16436 - protein, 1349 aa, Homo Sapiens
MACYLVISSRHLSNGHYRGIKGVFRGPLCKNGSPSPDFAEKKSTAKALEDVKANFYCELCDKQYHKHQEFDNHINSYDHAHKQRLKELKQREFARNVASKSWKDEKKQEKALKRLHQLAELRQQSECVSGNGPAYKAPRVAIEKQLQQGIFPIKNGRKVSCMKSALLLKGKNLPRIISDKQRSTMPNRHQLQSDRRCLFGNQVLQTSSDLSNANHRTGVSFTFSKKVHLKLESSASVFSENTEETHDCNKSPIYKTKQTADKCKCCRFANKDTHLTKEKEVNISPSHLESVLHNTISINSKILQDKHDSIDETLEDSIGIHASFSKSNIHLSDVDFTPTSREKETRNTLKNTLENCVNHPCQANASFSPPNIYNHSDARISECLDEFSSLEPSEQKSTVHLNPNSRIENREKSLDKTERVSKNVQRLVKEACTHNVASKPLPFLHVQSKDGHTTLQWPTELLLFTKTEPCISYGCNPLYFDFKLSRNTKEDHNLEDLKTELGKKPLELKTKRESQVSGLTEDQQKLIQEDYQYPKPKTMIANPDWEKFQRKYNLDYSDSEPNKSEYTFSANDLEMKNPKVPLYLNTSLKDCAGKNNSSENKLKEASRAHWQGCRKAVLNDIDEDLSFPSYISRFKKHKLIPCSPHLEFEDERQFNCKSSPCTVGGHSDHGKDFSVILKSNHISMTSKVSGCGNQRYKRYSPQSCLSRYSSSLDTSPSSMSSLRSTCSSHRFNGNSRGNLLCFHKREHHSVERHKRKCLKHNCFYLSDDITKSSQMQSEPQKERNCKLWESFKNEKYSKRRYCHCRERQKLGKNQQQFSGLKSTRIIYCDSNSQISCTGSSKKPPNCQGTQHDRLDSYSIEKMYYLNKSKRNQESLGSPHICDLGKVRPMKCNSGNISCLLKNCSSGPSETTESNTAEGERTPLTAKILLERVQAKKCQEQSSNVEISSNSCKSELEAPSQVPCTIQLAPSGCNRQALPLSEKIQYASESRNDQDSAIPRTTEKDKSKSSHTNNFTILADTDCDNHLSKGIIHLVTESQSLNIKRDATTKEQSKPLISEIQPFIQSCDPVPNEFPGAFPSNKYTGVTDSTETQEDQINLDLQDVSMHINHVEGNINSYYDRTMQKPDKVEDGLEMCHKSISPPLIQQPITFSPDEIDKYKILQLQAQQHMQKQLLSKHLRVLPAAGPTAFSPASTVQTVPVHQHTSITTIHHTFLQHFAVSASLSSHSSHLPIAHLHPLSQAHFSPISFSTLTPTIIPAHPTFLAGHPLHLVAATPFHPSHITLQPLPPTAFIPTLFGPHLNPATTSIIHLNPLIQPVFQGQDFCHHSCSSQMQQLNEVKEALNVSTHLN

SEQ ID NO: 16437 - protein, 627 aa, Homo Sapiens
MAMALTDPAQVSVTFDDVAVTFTQEEWGQLDLAQRTLYQEVMLENCGLLVSLGCPVPRPELIYHLEHGQEPWTRKEDLSQGTCPGDKGKPKSTEPTTCELALSEGISFWGQLTQGASGDSQLGQPKDQDGFSEMQGERLRPGLDSQKEKLPGKMSPKHDGLGTADSVCSRIIQDRVSLGDDVHDCDSHGSGKNPVIQEEENIFKCNECEKVFNKKRLLARHERIHSGVKPYECTECGKTFSKSTYLLQHHMVHTGEKPYKCMECGKAFNRKSHLTQHQRIHSGEKPYKCSECGKAFTHRSTFVLHNRSHTGEKPFVCKECGKAFRDRPGFIRHYIIHSGENPYECFECGKVFKHRSYLMWHQQTHTGEKPYECSECGKAFCESAALIHHYVIHTGEKPFECLECGKAFNHRSYLKRHQRIHTGEKPYVCSECGKAFTHCSTFILHKRAHTGEKPFECKECGKAFSNRADLIRHFSIHTGEKPYECMECGKAFNRRSGLTRHQRIHSGEKPYECIECGKTFCWSTNLIRHSIIHTGEKPYECSECGKAFSRSSSLTQHQRMHTGRNPISVTDVGRPFTSGQTSVNIQELLLGKNFLNVTTEENLLQEEASYMASDRTYQRETPQVSSL

SEQ ID NO: 16438 - protein, 589 aa, Homo Sapiens
MIKFQERVTFKDIAVIFTKEELAVLDKAQINLYQDVMLENFRNFISVDGIKNNILNLQGKGLIYLSQEELHCWKIWKQRIRDLSVSQDYIMNLQEQCSPHLEDVSLCEEWAGMSLQISENENYVVNAIIKNQDITAWQSLTQVLTPESWRKANIMTEPQKSQGRYKGIYVEEKLYRHARHDESLNWTSRDHHESQECKGEDPGRHPNCGKNLGMKSTVEQHHAVHVLPQPFTCNNCGVAFADDTDPRVHHSTHLGEKSYKCDQYGKNLSQSQYLIVHCKTHSGETPYEFHEWPTGCKQSSDLPRCQKVPSGDNPYKCKECGKGFRCNSSLHNHHRVHTGEMPYKCHVCGKAFGFRSLPCIHQGVHTGKKPYKCEDCGKGFEQSSNLLIHQRVHTGEKPYKSSECGKCFSSSSVLQVHWRFHTGEKPYRCGECGKGFSQSTHLHIHQRVHTGEKQYNAMCVERILGIVLFFTLIREFTLQKNHINAKCVESALVTVHIFTSIKAITQERNHINVMSVVKASVGIQIFNVHLRVHRGQRPCKCKACGKGFSRNSHLLAQQRVRIDKTQYTHCEHGKDLLTHQRLHEQRETL

SEQ ID NO: 16439 - protein, 903 aa, Homo Sapiens
MLREEAAQKRKGKESGMALPQGRLTFRDVAIEFSLAEWKFLNPAQRALYREVMLENYRNLEAVDISSKHMMKEVLSTGQGNREVIHTGTLQRHQSYHIGDFCFQEIEKEIHNIEFQCQEDERNGHEAPTTKIKKLTGSTDQHDHRHAGNKPIKDQLGSSFYSHLPELHIFQIKGEIANQLEKSTSDASSVSTSQRISCRPQIHISNNYGNNPLNSSLLPQKQEVHMREKSFPCNESGKAFNCSSLLRKHQIPHLGDKQYKCDVCGKLFNHKQYLACHRRCHTGEKPYKCKECGKSFSYKSSLTCHHRLHTGVKPYKCNECGKVFRQNSALVIHKAIHTGEKPYKCNECGKAFNQQSHLSRHQRLHTGVKPYKCKICEKAFACHSYLANHTRIHSGEKTYKCNECGKAFNHQSSLARHHILHTGEKPYKCEECDKVFSQKSTLERHKRIHTGEKPYKCKVCDTAFTCNSQLARHRRIHTGEKTYKCNECRKTFSRRSSLLCHRRLHSGEKPYKCNQCGNTFRHRASLVYHRRLHTLEKSYKCTVCNKVFMRNSVLAVHTRIHTAKKPYKCNECGKAFNQQSHLSRHRRLHTGEKPYKCEACDKVFGQKSALESHKRIHTGEKPYRCQVCDTAFTWNSQLARHTRIHTGEKTYKCNECGKTFSYKSSLVWHRRLHGGEKSYKCKVCDKAFVCRSYVAKHTRIHSGMKPYKCNECSKTFSNRSSLVCHRRIHSGEKPYKCSECSKTFSQKATLLCHRRLHSGEKPYKCNDCGNTFRHWSSLVYHRRLHTGEKSYKCTVCDKAFVRNSYLARHIRIHTAEKPYKCNECGKAFNEQSHLSRHHRIHTGEKPYKCEACDKVFSRKSHLKRHRIIHTGEKPYKCNECGKAFSDRSTLIHHQAIHGIGKFD

SEQ ID NO: 16440 - protein, 661 aa, Homo Sapiens
MPANEDAPQPGEHGSACEVSVSFEDVTVDFSREEWQQLDSTQRRLYQDVMLENYSHLLSVGFEVPKPEVIFKLEQGEGPWTLEGEAPHQSCSDGKFGIKPSQRRISGKSTFHSEMEGEDTRDDSLYSILEELWQDAEQIKRCQEKHNKLLSRTTFLNKKILNTEWDYEYKDFGKFVHPSPNLILSQKRPHKRDSFGKSFKHNLDLHIHNKSNAAKNLDKTIGHGQVFTQNSSYSHHENTHTGVKFCERNQCGKVLSLKHSLSQNVKFPIGEKANTCTEFGKIFTQRSHFFAPQKIHTVEKPHELSKCVNVFTQKPLLSIYLRVHRDEKLYICTKCGKAFIQNSELIMHEKTHTREKPYKCNECGKSFFQVSSLLRHQTTHTGEKLFECSECGKGFSLNSALNIHQKIHTGERHHKCSECGKAFTQKSTLRMHQRIHTGERSYICTQCGQAFIQKAHLIAHQRIHTGEKPYECSDCGKSFPSKSQLQMHKRIHTGEKPYICTECGKAFTNRSNLNTHQKSHTGEKSYICAECGKAFTDRSNFNKHQTIHTGEKPYVCADCGRAFIQKSELITHQRIHTTEKPYKCPDCEKSFSKKPHLKVHQRIHTGEKPYICAECGKAFTDRSNFNKHQTIHTGDKPYKCSDCGKGFTQKSVLSMHRNIHT

SEQ ID NO: 16441 - protein, 617 aa, Homo Sapiens
MALPQGLLTFRDVAIEFSQEEWKCLDPAQRTLYRDVMLENYRNLVSLDISSKCMMKEFSSTAQGNREVIHTGTLQRHESHHTGDFRFQEIDKDIHNLEFQWQEDERNSHEAPMTEIKKLTGSADRYDQRHAGNKPIKDQLGSSFHSHLPELHMFQTQGKIGNQVEKSINDASSISTSQRISCRPKTHISNNYGNNFRNSSLLTQKQEVHMREKSFQCNESGKAFNYSSLLRKHQIIHLGEKQYKCDVCGKVFNRKRNLVCHRRCHTGEKPYRCNECGKTFSQTYSLTCHRRLHTGEKPYKCEECDKAFSFKSNLKRHRRIHAGEKPYKCNECGKTFSQTSSLTCHRRLHTGEKPFKCNECGKTFSRKSSLTCHHRLHTGEKPYKCNECGKTFSQELTLKCHRRLHTGEKPYKCNECGKVFNKKANLARHHRLHSGEKPYKCTECVKTFSRNSALVIHKAIHIGEKRYKCNECGKTFSRISALVIHTAIHTGEKPYKCNECGKGFNRKTHLACHHRLHTGEKPYKCNECGKVFNRKTHLAHHHRLHTGDKPYKCNECGKVFNQKAHLARHHRLHTGEKPYKCNECGKVFNQKANLARHHRLHTGEKPYKFNECGKAFN

SEQ ID NO: 16442 - protein, 855 aa, Homo Sapiens
MAAAATLRLSAQGTVTFEDVAVNFTWEEWNLLSEAQRCLYRDVTLENLALISSLGCWCGVEDEAAPSKQSIYIQRETQVRTPMAGVSPKKAHPCEMCGPILGDILHVADHQGTHHKQKLHRCEAWGNKLYDSGNFHQHQNEHIGEKPYRGSVEEALFAKRCKLHVSGESSVFSESGKDFLPRSGLLQQEASHTGEKSNSKTECVSPIQCGGAHYSCGESMKHFSTKHILSQHQRLLTREECYVCCECGKSFSKYASLSNHQRVHTEKKHECGECGKSFSKYVSFSNHQRVHTEKKHECGECGKSFSKYVSFSNHQRVHTGKRPYECGECGKSFSKYASFSNHQRVHTEKKHYECGECGKSFSKYVSFSNHQRVHTGKRPYECGECGKSFSKYASFSNHQRVHTDKKHYECGECGKSFSQKSSLIQHQRFHTGEKPYGCEECGKSFSSEGHLRSHQRVHAGERPFKCGECVKSFSHKRSLVHHQRVHSGERPYQCGECGKSFSQKGNLVLHQRVHTGARPYECGECGKSFSSKGHLRNHQQIHTGDRLYECGECGKSFSHKGTLILHQRVHPRERSYGCGECGKSFSSIGHLRSHQRVHTGERPYECGECGKSFSHKRSLVHHQRMHTGERPYKCGDCGKSFNEKGHLRNHQRVHTTERPFKCGECGKCFSHKGNLILHQHGHTGERPYVCRECGKLFKKKSHLLVHQRIHNGEKPYACEACQKFFRNKYQLIAHQRVHTGERPYECNDCGKSFTHSSTFCVHKRIHTGEKPYECSECGKSFAESSSFTKHKRVHTGEKPYECSECGKSFAESSSLTKHKRVHTGEKPYKCEKCGKLFNKKSHLLVHQSSHWRKAI

SEQ ID NO: 16443 - protein, 651 aa, Homo Sapiens
MLREEATKKSKEKEPGMALPQGRLTFRDVAIEFSLEEWKCLNPAQRALYRAVMLENYRNLEFVDSSLKSMMEFSSTRHSITGEVIHTGTLQRHKSHHIGDFCFPEMKKDIHHFEFQWQEVERNGHEAPMTKIKKLTGSTDRSDHRHAGNKPIKDQLGLSFHSHLPELHMFQTKGKISNQLDKSIGASSASESQRISCRLKTHISNKYGKNFLHSSFTQIQEICMREKPCQSNECGKAFNYSSLLRRHHITHSREREYKCDVCGKIFNQKQYIVYHHRCHTGEKTYKCNECGKTFTQMSSLVCHRRLHTGEKPYKCNECGKTFSEKSSLRCHRRLHTGEKPYKCNECGKTFGRNSALVIHKAIHTGEKPYKCNECGKTFSQKSSLQCHHILHTGEKPYKCEECDNVYIRRSHLERHRKIHTGEGSYKCKVCDKVFRSDSYLAEHQRVHTGEKPYKCNKCGRSFSRKSSLQYHHTLHTGEKPYTCNECGKVFSRRENLARHHRLHAGEKPYKCEECDKVFSRRSHLERHRRIHTGEKPYKCKVCDKAFRSDSCLANHTRVHTGEKPYKCNKCAKVFNQKGILAQHQRVHTGEKPYKCNECGKVFNQKASLAKHQRVHTAEKPYKCNECGKAFTGQSTLIHHQAIHGCRETLQM

SEQ ID NO: 16444 - protein, 412 aa, Homo Sapiens
MSRRKQTNPNKVHWDQVFAGLEEQARQAMMKTDFPGDLGSQRQAIQQLRDQDSSSSDSEGDEEETTQDEVSSHTSEEDGGVVKVEKELENTEQPVGGNEVVEHEVTGNLNSDPLLELCQCPLCQLDCGSREQLIAHVYQHTAAVVSAKSYMCPVCGRALSSPGSLGRHLLIHSEDQRSNCAVCGARFTSHATFNSEKLPEVLNMESLPTVHNEGPSSAEGKDIAFSPPVYPAGILLVCNNCAAYRKLLEAQTPSVRKWALRRQNEPLEVRLQRLERERTAKKSRRDNETPEEREVRRMRDREAKRLQRMQETDEQRARRLQRDREAMRLKRANETPEKRQARLIREREAKRLKRRLEKMDMMLRAQFGQDPSAMAALAAEMNFFQLPVSGVELDSQLLGKMAFEEQNSSSLH

SEQ ID NO: 16445 - protein, 610 aa, Homo Sapiens
MDSVAFEDVAVNFTQEEWALLGPSQKSLYRNVMQETIRNLDCIEMKWEDQNIGDQCQNAKRNLRSHTCEIKDDSQCGETFGQIPDSIVNKNTPRVNPCDSGECGEVVLGHSSLNCNIRVDTGHKSCEHQEYGEKPYTHKQRGKAISHQHSFQTHERPPTGKKPFDCKECAKTFSSLGNLRRHMAAHHGDGPYKCKLCGKAFVWPSLFHLHERTHTGEKPYECKQCSKAFPFYSSYLRHERIHTGEKAYECKQCSKAFPDYSTYLRHERTHTGEKPYKCTQCGKAFSCYYYTRLHERTHTGEQPYACKQCGKTFYHHTSFRRHMIRHTGDGPHKCKICGKGFDCPSSVRNHETTHTGEKPYECKQCGKVLSHSSSFRSHMITHTGDGPQKCKICGKAFGCPSLFQRHERTHTGEKPYQCKQCGKAFSLAGSLRRHEATHTGVKPYKCQCGKAFSDLSSFQNHETTHTGEKPYECKECGKAFSCFKYLSQHKRTHTVEKPYECKTCRKAFSHFSNLKVHERIHSGEKPYECKECGKAFSWLTCLLRHERIHTGEKPYECLQCGKAFTRSRFLRGHEKTHTGEKLYECKECGKALSSLRSLHRHKRTHWKDTL

SEQ ID NO: 16446 - protein, 1081 aa, Homo Sapiens
MPRRKQEQPKRLPSHVSRQEEAEGELSEGEHWYGNSSETPSEASYGEVQENYKLSLEDRIQEQSTSPDTSLGSTTPSSHTLELVALDSEVLRDSLQCQDHLSPGVSSLCDDDPGSNKPLSSNLRRLLEAGSLKLDAAATANGRVESPVNVGSNLSFSPPSHHAQQLSVLARKLAEKQEQNDQYTPSNRFIWNQGKWLPNSTTTCSLSPDSAILKLKAAANAVLQDKSLTRTEETMRFESFSSPFSSQSASSTLAALSKKVSERSLTPGQEHPPPASSFLSLASMTSSAALLKEVAARAAGSLLAEKSSLLPEDPLPPPPSEKKPEKVTPPPPPPPPPPPPPPPQSLELLLLPVPKGRVSKPSNSASEEESGKPFQCPICGLVIKRKSYWKRHMVIHTGLKSHQCPLCPFRCARKDNLKSHMKVHQHQDRGETFQCQLCPFTSSRHFSLKLHMRCHQHFLRTEAKVKEEIPDPDVKGSPHLSDSACLGQQREGGGTELVGTMMTSNTPERTSQGGAGVSPLLVKEEPKEDNGLPTSFTLNAADRPANHTKLKDPSEYVANSASALFSQDISVKMASDFLMKLSAANQKEPMNLNFKVKEEPKEGESLSTTLPRSSYVFSPESEVSAPGVSEDALKPQEGKGSVLRRDVSVKAASELLMKLSAESYKETQMVKIKEEPMEVDIQDSHVSISPSRNVGYSTLIGREKTEPLQKMPEGRVPPERNLFSQDISVKMASELLFQLSEKVSKEHNHTKENTIRTTTSPFFSEDTFRQSPFTSNSKELLPSDSVLHGRISAPETEKIVLEAGNGLPSWKFNDQLFPCDVCGKVFGRQQTLSRHLSLHTEERKYKCHLCPYAAKCRANLNQHLTVHSVKLVSTDTEDIVSAVTSEGSDGKKHPYYYSCHVCGFETELNVQFVSHMSLHVDKEQWMFSICCTACDFVTMEEAEIKTHIGTKHTGEDRKTPSESNSPSSSSLSALSDSANSKDDSDGSQKNKGGNNLLVISVMPGSQPSLNSEEKPEKGFECVFCNFVCKTKNMFERHLQIHLITRMFECDVCHKFMKTPEQLLEHKKCHTVPTGGLNSGQW

SEQ ID NO: 16447 - protein, 432 aa, Homo Sapiens
MPHSPLISIPHVWCHPEEEERMHDELLQAVSKGPVMFRDVSIDFSQEEWECLDADQMNLYKEVMLENFSNLVSVGLSNSKPAVISLLEQGKEPWMVDRELTRGLCSDLESMCETKILSLKKRHFSQVIITREDMSTFIQPTFLIPPQKTMSEEKPWECKICGKTFNQNSQFIQHQRIHFGEKHYESKEYGKSFSRGSLVTRHQRIHTGKKPYECKECGKAFSCSSYFSQHQRIHTGEKPYECKECGKAFKYCSNLNDHQRIHTGEKPYECKVCGKAFTKSSQLFLHLRIHTGEKPYECKECGKAFTQHSRLIQHQRMHTGEKPYECKQCGKAFNSASTLTNHHRIHAGEKLYECEECRKAFIQSSELIQHQRIHTDEKPYECNECGKAFNKGSNLTRHQRIHTGEKPYDCKECGKAFGSRSDLIRHEGIHTG

SEQ ID NO: 16448 - protein, 516 aa, Homo Sapiens
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCSERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVCGKVFHHISHLAQHQRIHTGEKPYKCNECGKVFSHKSSLVNHWRIHTGEKPYKCNECGKVFSHKSSLVNHWRIHTGEKPYKCNECGKVFSRNSYLAQHLIIHAGEKPYKCDECDKAFSQNSHLVQHHRIHTGEKPYKCDECGKVFSQNSYLAYHWRIHTGEKAYKCNECGKVFGLNSSLAHHRKIHTGEKPFKCNECGKAFSMRSSLTNHHAIHTGEKHFKCNECGKLFRDNSYLVRHQRFHAGKKSNTCN

SEQ ID NO: 16449 - protein, 372 aa, Homo Sapiens
MASSASARTPAGKRVINQEELRRLMKEKQRLSTSRKRIESPFAKYNRLGQLSCALCNTPVKSELLWQTHVLGKQHREKVAELKGAKEASQGSSASSAPHSVKRKAPDADDQDVKRAKATLVPQVQPSTSAWTTNFDKIGKEFIRATPSKPSGLSLLPDYEDEEEEEEEEEGDGERKRGDASKPLSDAQGKEHSVSSSREVTSSVLPNDFFSTNPPKAPIIPHSGSIEKAEIHEKVVERRENTAEALPEGFFDDPEVDARVRKVDAPKDQMDKEWDEFQKAMRQVNTISEAIVAEEDEEGRLDRQIGEIDEQIECYRRVEKLRNRQDEIKNKLKEILTIKELQKKEEENADSDDEGELQDLLSQDWRVKGALL

SEQ ID NO: 16450 - protein, 1677 aa, Homo Sapiens
MEVPEPTCPAPPARDQPAPTPGPPGAPGGQASPHLTLGPVLLPPEQGLAPPTVFLKALPIPLYHTVPPGGLQPRAPLVTGSLDGGNVPFILSPVLQPEGPGPTQVGKPAAPTLTVNIVGTLPVLSPGLGPTLGSPGKVRNAGKYLCPHCGRDCLKPSVLEKHIRSHTGERPFPCATCGIAFKTQSNLYKHRRTQTHLNNSRLSSESEGAGGGLLEEGDKAGEPPRPEGRGESRCQGMHEGASERPLSPGAHVPLLAKNLDVRTEAAPCPGSAFADREAPWDSAPMASPGLPAASTQPWRKLPEQKSPTAGKPCALQRQQATAAEKPWDAKAPEGRLRKCESTDSGYLSRSDSAEQPHAPCSPLHSLSEHSAESEGEGGPGPGPGVAGAEPGAREAGLELEKKRLEERIAQLISHNQAVVDDAQLDNVRPRKTGLSKQGSIDLPTPYTYKDSFHFDIRALEPGRRRAPGPVRSTWTPPDKSRPLFFHSVPTQLSTTVECVPVTRSNSLPFVEGSRTWLEPREPRDPWSRTQKPLSPRPGPARLGCRSGLSSTDVPSGHPRALVRQAAVEDLPGTPIGDALVPAEDTDAKRTAAREAMAGKGRAGGRKCGQRRLKMFSQEKWQVYGDETFKRIYQKMKASPHGGKKAREVGMGSGAELGFPLQKEAAGSSGTVPTQDRRTPVHEDISAGATPEPWGNPPALEASLVTEPTKHGETVARRGDSDRPRVEEAVSSPALGGRDSPCSGSRSPLVSPNGRLELGWQMPPAPGPLKGGDVEAPRPVWPDPKLEGGARGVGDVQETCLWAQTVLRWPSRGSGEDKLPSERKKLKVEDLHSWKQPEPVSAETPGGPTQPASLSSQKQDADPGEVPGGSKESARQVGEPLESSGASLAAASVALKRVGPRDKATPLHPAAPAPAEHPSLATPPQAPRVLSALADNAFSPKYLLRLPQAETPLPLPIPWGPRHSQDSLCSSGWPEERASFVGSGLGTPLSPSPASGPSPGEADSILEDPSCSRPQDGRKGAQLGGDKGDRMATSRPAARELPISAPGAPREATSSPPTPTCEAHLVQDMEGDSHRIHRLCMGSTLARARLSGDVLNPWVPNWELGEPPGNAPEDPSSGPLVGPDPCSPLQPGSFLTALTRPQGVPPGWPELALSSHSGTSRSHSTRSPHSTQNPFPSLKAEPRLTWCCLSRSVPLPAEQKAKAASVYLAVHFPGSSLRDEGPNGPPGSNGGWTWTSPGEGGPAQMSKFSYPTVPGVMPQHQVSEPEWKKGLPWRAKMSRGNSKQRKLKINPKRYKGNFLQSCVQLRASRLRTPTWVRRRSRHPPALEGLKPCRTPGQTSSEIAGLNLQEEPSCATSESPPCCGKEEKKEGDCRQTLGTLSLGTSSRIVREMDKRTVKDISPSAGEHGDCTTHSTAATSGLSLQSDTCLAVVNDVPLPPGKGLDLGLLETQLLASQDSVSTDPKPYIFSDAQRPSSFGSKGTFPHHDIATSVAAVCISLPVRTDHIAQEIHSAESRDHSQTAGRTLTSSSPDSKVTEEGRAQTLLPGRPSSGQRISDSVPLESTEKTHLEIPASGPSSASSHHKEGRHKTFFPSRGQYGCGEMTVPCPSLGSDGRKRQVSGLITRKDSVVPSKPEQPIEIPEAPSKSLKKRSLEGMRKQTRVEFSDTSSDDEDRLVIEI

SEQ ID NO: 16451 - protein, 187 aa, Homo Sapiens
MVMHSEDEPYKCKFCGKAFDNLHLYLTHERTHTGEKPYECNKCGKAFSCSSSIRKHARIHTGEKPYICKQCGKAFRYSSSIRNHENTHTGEKPCECKQCGKAFSYSSYFRIHERIHTGEQVYKCKECGKTFTYPSAFHKHKSTHTSQKLYECKECGKAFDCFSSFHSHEGVHTGEKPYECRTWKSLQ

SEQ ID NO: 16452 - protein, 537 aa, Homo Sapiens
MEGLLSVALQGAELEGNWKHEGQVEDLQENQESCPEPEAVACKGDPAGDSMQERDEFSRIPRTISSPAATQASVPDDSSSRRCSAPGESPKERHPDSRQRERGGGPKKPWKCGDCGKAFSYCSAFILHQRIHTGEKPFACPECGKAFSQSVHLTLHQRTHTGEKPYACHECGKAFSQGSYLASHWRTHTGEKPHRCADCGKAFTRVTHLTQHRRVHTGERPYACAQCAKAFRNRSSLIEHQRIHTGEKPYECSACAKAFRFSSALIRHQRIHTEEKPYRCGQCAKAFAQIAHLTQHRRVHTGEKPYTCQDCGALFSQSASLAEHRRIHTGEKPYACGQCAKAFTQVSHLTQHQRTHTGERPYPCHDCGKRFSNRSHLLQHRLVHTGERPYRCLQCGAAFSHVSSLIEHQKIHTGERPYKCGECGKAFSQGSSLALHQRTHTGERPYTCPECGKAFSNRSYLIQHHIVHTGEKPYECSGCGKAFSFSSALIRHQRTHADSSGRLCPAPTPDSTPGLSQGGETCQQGCPGRNPRGPAED

SEQ ID NO: 16453 - protein, 936 aa, Homo Sapiens
MALTQGPLTFRDVAIEFSQEEWKSLDPVQKALYWDVMLENYRNLVFLGILPKCMTKELPPIGNSNTGEKCQTVTLERHECYDVENFYLREIQKNLQDLEFQWKDGEINYKEVPMTYKNNLNGKRGQHSQEDVENKCIENQLTLSFQSRLTELQKFQTEGKIYECNQSEKTVNNSSLVSPLQRILPSVQTNISKKYENEFLQLSLPTQLEKTHIREKPYMCKGCGKAFRVSSSLINHQMVHTTEKPYKCNECGKAFHRGSLLTIHQIVHTRGKPYQCGVCGKIFRQNSDLVNHRRSHTGEKPYKCNECGKSFSQSYNLAIHQRIHTGEKPYKCNECGKTFKQGSCLTTHQIIHTGEKPYQCDICGKVFRQNSNLVNHQRIHTGEKPYKCNICGKSFSQSSNLATHQTVHSGNKPYKCDECGKTFKRSSSLTTHQIIHTGEKPYTCDVCDKVFSQRSQLARHQRSHTGEKPYKCNECGKVFSQTSHLVGHRRIHTGEKPYKCDKCGKAFKQGSLLTRHKIIHTREKRYQCGECGKVFSENSCLVRHLRIHTGEQPYKCNVCGKVFNYSGNLSIHKRIHTGEKPFQCNECGTVFRNYSCLARHLRIHTGQKPYKCNVCGKVFNDSGNLSNHKRIHTGEKPFQCNECGKVFSYYSCLARHRKIHTGEKPYKCNDCGKAYTQRSSLTKHLIIHTGEKPYNCNEFGGAFIQSSKLARYHRNPTGEKPHKCSHCGRTFSHITGLTYHQRRHTGEMPYKCIECGQVFNSTSNLARHRRIHTGEKPYKCNECGKVFRHQSTLARHRSIHTGEKPYVCNECGKAFRVRSILVNHQKMHTGDKPYKCNECGKAFIERSKLVYHQRNHTGEKPYKCIECGKAFGRFSCLNKHQMIHSGEKPYKCNECGKSFISRSGLTKHQTKHTAESLKTKFNVEKPLDVLLTSGFK

SEQ ID NO: 16454 - protein, 531 aa, Homo Sapiens
MEAPAQKAGQGGLPKADAQGASGAREKRPEEPRPLEEDRAGSRPTQKGDLRGAAGGRTTPPGGGSRGCSLGVSPGPGTRHSAGTRPLVREPCGPTSSQNPELVIPEGLQAREGPCRSPARGGDCSRNSCLAWHRGAPAGETPPVCDPCPERIQNHPRTQLCEVHTDCWPCQPGTGAPTCPRTPKPTSRGRNPLVEQPRACACGEAFAWRALRIPQERLQATEEPRPCARCGKRFRPNQQQQAGKSPPVCPECGQTSRPRPIVPDPPAQRLYACDECGKAFTRTSSLLQHQRIHTGERPYECAECGKAFVRCSGLYRHQKTHSAERHRRGPVLARRAFRLGCPPCGDYSERSPRRGSGAGEKPYECADCAKAFGLFSHLVEHRRVHTGEKPYACPECGKAFNQRSNLSRHQRTHSSAKPYACPLCEKAFKGRSGLVQHQRAHTGERPYGCSECGKTFRGCSELRQHERLHSGEKPYICRDCGKAFVRNCSLVRHLRTHTGERPYACGDCGRAFSQRSNLNEHRKRHGGRAAP

SEQ ID NO: 16455 - protein, 811 aa, Homo Sapiens
MLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSRPPKYKAKDYKFIKTEDLADGHLSDSDDYSELCVEEDEDQRERHALFDLSSCSLRPKSFKCQTCEKSYIGKGGLARHFKLNPGHGQLDPEMVLSEKASGSTLRGCTEERTLSLTSLGLSMPADPCEGGARSCLVTESARGGLQNGQSVDVEETLPSEPENGALLRSERYQGPRRRACSETLAESRTAVLQQRRAAQLPGGPAAAGEQRASPSKARLKEFLQQCDREDLVELALPQLAQVVTVYEFLLMKVEKDHLAKPFFPAIYKEFEELHKMVKKMCQDYLSSSGLCSQETLEINNDKVAESLGITEFLRKKEIHPDNLGPKHLSRDMDGEQLEGASSEKREREAAEEGLASVKRPRREALSNDTTESLAANSRGREKPRPLHALAAGFSPPVNVTVSPRSEESHTTTVSGGNGSVFQAGPQLQALANLEARRGSIGAALSSRDVSGLPVYAQSGEPRRLTQAQVAAFPGENALEHSSDQDTWDSLRSPGFCSPLSSGGGAESLPPGGPGHAEAGHLGKVCDFHLNHQQPSPTSVLPTEVAAPPLEKILSVDSVAVDCAYRTVPKPGPQPGPHGSLLTEGCLRSLSGDLNRFPCGMEVHSGQRELESVVAVGEAMAFEISNGSHELLSQGQKQIFIQTSDGLILSPPGTIVSQEEDIVTVTDAEGRACGWAR

SEQ ID NO: 16456 - protein, 738 aa, Homo Sapiens
MTMLQESFSFDDLSVDFTQKEWQLLDPSQKNLYKDVMLENYSSLVSLGYEVMKPDVIFKLEQGEEPWVGDGEIPSSDSPEVWKVDGNMMWHQDNQDKLKIIKRGHECDAFGKNFNLNMNFVPLRKSNSEGDLDGLILKHHLDLLIPKGDYGKAESDDFNVFDNFFLHSKPEDTDTWLKYYDCDKYKESYKKSQIIIYHRNRLGEKLYECSECRKRFSKKPSLIKHQSRHIRDIAFGCGNCGKTFPQKSQFITHHRTHTGEKPYNCSQCGKAFSQKSQLTSHQRTHTGEKPYECGECGKAFSRKSHLISHWRTHTGEKPYGCNECGRAFSEKSNLINHQRIHTGEKPFECRECGKAFSRKSQLVTHHRTHTGTKPFGCSDCRKAFFEKSELIRHQTIHTGEKPYECSECRKAFRERSSLINHQRTHTGEKPHGCIQCGKAFSQKSHLISHQMTHTGEKPFICSKCGKAFSRKSQLVRHQRTHTGEKPYECSECGKAFSEKLSLTNHQRIHTGEKPYVCSECGKAFCQKSHLISHQRTHTGEKPYECSECGKAFGEKSSLATHQRTHTGEKPYECRDCEKAFSQKSQLNTHQRIHTGEKPYECSLCRKAFFEKSELIRHLRTHTGEKPYECNECRKAFREKSSLINHQRIHTGEKPFECSECGKAFSRKSHLIPHQRTHTGEKPYGCSECRKAFSQKSQLVNHQRIHTGEKPYRCIECGKAFSQKSQLINHQRTHTVKKS

SEQ ID NO: 16457 - protein, 716 aa, Homo Sapiens
MSLMGHGKVEMLLYAVPLLKAPNCLSSSMQLPHGGGRHQELVRFRDVAVVFSPEEWDHLTPEQRNLYKDVMLDNCKYLASLGNWTYKAHVMSSLKQGKEPWMMEREVTGDPCPACQPALATFRALNESGNAFRQSFHHGEYRTHRTFVQHYECDDCGMAFGHVSQLTGHQKIHKVGETHEYGENTRGFRHRSSFTMLQRICTLYKHFECNQCGETFNRPSKVIQHQSMHSGLKPYKCDVCQKAFRFLSSLSIHQRFHVGNRVNLTRHQKTHTQRKPFSCNFCGKTFHRFSEKTQHLLIHTRKKYYTCNYCKKEFNPYSKFILHQRTHTGEKPHKCDVCEKSFKSISNLNKHQKTHTGEKPFSCNECKKTFAQRTDLARHQQIHTGKKSFICSSCKKTFVRLSDLTQHKGTHTGERPYQCTTCEKAFKYRSNFTKHQKTHSIGRPFACNECGKTYRLNWELNQHKKIHTGEKPYECGECGKRFNNNSNLNKHKKIHTGEKHFVCNQCGKAFSLNSKLSRHQRTHNKKENSSKSVSNLNKHQKTHAGEKPFPCNECKKAFAQRMDLARHQQIHTGRKPFICSSCKKTFVRLSDLTQHKGTHTGERPYQCTTCEKAFKYQSNFTKHQKTHSIGRPFTCNECGKTFRLNWKLNQHKKIHTGEKPYECGECGKCFNNNSNLSKHKKIHTGEKHFVCNQCGKAFSLNSKLSRHQITHNKKKP

SEQ ID NO: 16458 - protein, 808 aa, Homo Sapiens
MLEGHESYDTENFYFREIRKNLQEVDFQWKDGEINYKEGPMTHKNNLTGQRVRHSQGDVENKHMENQLILRFQSGLGELQKFQTAEKIYGCNQIERTVNNCFLASPLQRIFPGVQTNISRKYGNDFLQLSLPTQDEKTHIREKPYIGNECGKAFRVSSSLINHQMIHTTEKPYRCNESGKAFHRGSLLTVHQIVHTRGKPYQCDVCGRIFRQNSDLVNHRRSHTGDKPYICNECGKSFSKSSHLAVHQRIHTGEKPYKCNRCGKCFSQSSSLATHQTVHTGDKPYKCNECGKTFKRNSSLTAHHIIHAGKKPYTCDVCGKVFYQNSQLVRHQIIHTGETPYKCNECGKVFFQRSRLAGHRRIHTGEKPYKCNECGKVFSQHSHLAVHQRVHTGEKPYKCNECGKAFNWGSLLTVHQRIHTGEKPYKCNVCGKVFNYGGYLSVHMRCHTGEKPLHCNKCGMVFTYYSCLARHQRMHTGEKPYKCNVCGKVFIDSGNLSIHRRSHTGEKPFQCNECGKVFSYYSCLARHRKIHTGEKPYKCNDCGKAYTQRSSLTKHLVIHTGENPYHCNEFGEAFIQSSKLARYHRNPTGEKPHKCSECGRTFSHKTSLVYHQRRHTGEMPYKCIECGKVFNSTTTLARHRRIHTGEKPYKCNECGKVFRYRSGLARHWSIHTGEKPYKCNECGKAFRVRSILLNHQMMHTGEKPYKCNECGKAFIERSNLVYHQRNHTGEKPYKCMECGKAFGRRSCLTKHQRIHSSEKPYKCNECGKSYISRSGLTKHQIKHAGENLTTKLNVERPLDVVLTSGIPK

SEQ ID NO: 16459 - protein, 348 aa, Homo Sapiens
MRSLPFALTVESVSARAPTCCSTGRFTQGRQPCKCKACGRGFTQSASLLQHWRVHSDWRETLSLSPVRQDLLWPLQPHQAPASPLGRSHSSAGVRQGFSGQLCCWLTKEHTLAEALRLSPVPAGFWGPVEADRPPANSHRRVCPFCCCSCGDSVNEKTSLSQRVLPHPGEKTCRGGSVESVSLAPSSVAPDSTSGLRPCGSPGSFLQHLPPSTLLPRPPFLYPGPPLSLQPLVPSGLPAVPAVPLGGLEVAQVPPATQPAAQQEGAMGPRSCASAGRDSREAVQAPGYPEPARKASQHRAAGPLGEARARLQRQCRAPPPPSNPHWRGALPVFPVWKASSRRSNLARH

SEQ ID NO: 16460 - protein, 666 aa, Homo Sapiens
MDLVAFEDVAVNFTQEEWSLLDPSQKNLYREVMQETLRNLASIGEKWKDQNIEDQYKNPRNNLRSLLGERVDENTEENHCGETSSQIPDDTLNKKTSPGVKSCESSVCGEVFVGHSSLNRHIRADTAHKPSEYQEYGQEPYKCQQRKKAFRCHPSFQMQEKAHTGEKLYDCKECGKTFISHSSIQRHMIMHNGDGTYKCKFCGKACPCLSIYLIHERVHTGEKPYKCKQCGKAFSYSTSLQIHERTHTGEKPYECKECGKAFGSPNSLYEHRRTHTGEKPYECKQCGKAFRWFHSFQIHERTHSEEKAYECTKCGKAFKCPSYLCRHEVTHSGKKPCECKQCGKALSYLNFQRHMKMHTRMRPYKCKTVEKPLILPVRFEDMKELTLERNLMNASTVVKPSIVPVPFTIMKGLTLERNPMNVSSVVKPSFLPLPFDIMKGLTLERNRMSVSNVGKPSDLPHTFKCMEGLTLKRNPMNVSSVVKPSFFPLPFDIMKGLTLERNPMSVSNVGKPSHLPHTFKCMKGLTLESNCMNLNNVKKPLDLSETFKFMKRHTLERNPIRNMEKHSTISLPFKYMQQCTEDRMPMNVKSVTKHSYLPRSFEYMQEHTLERNPMNVRNAEKRSIIFLLCVYTKGCTLERNHINVRIVGKHSVCLVPFVDIKGLTLE

SEQ ID NO: 16461 - protein, 970 aa, Homo Sapiens
MALSQGLLTFRDVAIEFSQEEWKCLDPAQRTLYRDVMLENYRNLVSLDISSKCMMKEFSSTAQGNTEVIHTGTLQRHERHHIGDFCFQEMEKDIHDFEFQWKEDERNSHEAPMTEIKQLTGSTNRHDQRHAGNKPIKDQLGSSFHSHLPELHMFQTEGKIGNQVEKSINSASLVSTSQRISCRPKTHISKNYGNNFLNSSLLTQKQEVHMREKSFQCNESGKAFNYSSVLRKHQIIHLGAKQYKCDVCGKVFNQKRYLACHRRCHTGKKPYKCNDCGKTFSQELTLTCHHRLHTGEKHYKCSECGKTFSRNSALVIHKAIHTGEKSYKCNECGKTFSQTSYLVYHRRLHTGEKPYKCEECDKAFSFKSNLERHRKIHTGEKPYKCNECSRTFSRKSSLTRHRRLHTGEKPYKCNDCGKTFSQMSSLVYHRRLHTGEKPYKCEECDEAFSFKSNLERHRRIHTGEKPYKCNDCGKTFSQTSSLVYHRRLHTGEKPYKCEECDEAFSFKSNLERHRIIHTGEKLYKCNECGKTFSRKSSLTRHCRLHTGEKPYQCNECGKAFRGQSALIYHQAIHGIGKLYKCNDCHQVFSNATTIANHWRIHNEERSYKCNRCGKFFRHRSYLAVHWRTHSGEKPYKCEECDEAFSFKSNLQRHRRIHTGEKPYRCNECGKTFSRKSYLTCHRRLHTGEKPYKCNECGKTFGRNSALIIHKAIHTGEKPYKCNECGKAFSQKSSLTCHLRLHTGEKPYKCEECDKVFSRKSSLEKHRRIHTGEKPYKCKVCDKAFGRDSHLAQHTRIHTGEKPYKCNECGKNFRHNSALVIHKAIHSGEKPYKCNECGKTFRHNSALEIHKAIHTGEKPYKCSECGKVFNRKANLSRHHRLHTGEKPYKCNKCGKVFNQQAHLACHHRIHTGEKPYKCNECGKTFRHNSVLVIHKTIHTGEKPYKCNECGKVFNRKAKLARHHRIHTGKKH

SEQ ID NO: 16462 - protein, 533 aa, Homo Sapiens
MDSSQHLVTFEDVAVDFTQEEWTLLDQAQRDLYRDVMLENYKNLIILAGSELFKRSLMSGLEQMEELRTGVTGVLQELDLQLKTKGSPLLQDISAERSPNGVQLERSNTAEKLYDSNHSGKVFNEHPFLMTHMITHIGEKTSEDNQSGKALRKNFPHSFYKKSHAEGKMPKCVKHEKAFNQFPNLTRQNKTHTQEKLCECKDCWRTFLNQSSLKLHIRSHNGDKHYVCKECGKAFSNSSHLIGHGRIHSGEKPYVCKECGKAFTQSTGLKLHIRTHSGEKPYKCKECGKAFTHSSYLTDHTRIHSGKKPYVCMECGKAFTRSTGLILHMRIHTGEKPYECKECGKAFIHSSYLTKHVRIHSGEKLYLCKACGKAFTRSSGLVLHMRTHTGEKPYECKECGKAFNNSSMLSQHVRIHTGEKPYECKECGKAFTQSSGLSTHLRTHTGEKACECKECGKAFARSTNLNMHMRTHTGEKPYACKECGKAFRYSTYLNVHTRTHTGAKPYECKKCGKNFTQSSALAKHLRTKACEKT

SEQ ID NO: 16463 - protein, 595 aa, Homo Sapiens
MGPLTFRDVAIEFSLKEWQCLDTAQRNLYRNVMLENYRNLVFLGITVSKPDLITCLEQGKEAWSMKRHEIMVAKPTVMCSHFAQDLWPEQNIKDSFQKVTLKRYGKCRHENLPLRKGCESMDECKMHKGGCNGLNQCLTATQSKIFQCDKYVKVAHKFSNSNRHEIRHTKKKPFKCTKCGKSFGMISCLTEHSRIHTRVNFYKCEECGKAFNWSSTLTKHKRIHTGEKPYKCEECGKAFNQSSNLIKHKKIHTGEKPYKCEECGKTFNRFSTLTTHKIIHTGEKPYKCKECGKAFNRSSTLTTHRKIHTGEKPYKCEECGKAFKQSSNLTTHKIIHTGEKPYKCKKCGKAFNQSAHLTTHEVIHTGEKPYKCEKCGKAFNHFSHLTTHKIIHTGEKPYKCKECGKAFKHSSTLTKHKIIHTGEKPYKCKECEKAFNQSSKLTEHKKIHTGEKPYECEKCGKAFNQSSNLTRHKKSHTEEKPYKCEECGKGFKWPSTLTIHKIIHTGEKPYKCEECGKAFNQSSKLTKHKKIHTGEKPYTCEECGKAFNQSSNLTKHKRIHTGEKPYKCEECDKAFKWSSVLTKHKIIHTGEKLQI

SEQ ID NO: 16464 - protein, 659 aa, Homo Sapiens
MLHQPTPGNRGLTARMEVGPATETFVLELQCLEDGGPGPDTLSGGSGGSESQEEEEPQERNSSPQRPAVSAPVGASEIAEETRPGQRELQLQQLEQQPEPQQQPQHEQLQQPQPHLELQQQPQQDGQQQLSQLQQEKHQSVHHQELKPELQLMHQQQQLQPQQVQEQQRLQQQQEQLQTQQAQEQQVLQQQEQLQQQVQEQQLLQQQQEQLQQQQLLQQQEQLQQQQFQQQQEQLQQQQQLLLLQQQGQLQQQLLQQQQAQLQQQLLEQQQAQLQQQLLLQQQEQLQQQQQQQLLQQQQEQLQQQQLQPPPLEPEEEEEVELELMPVDLGSEQELEQQRQELERQQELERQQEQRQLQLKLQEELQQLEQQLEQQQQQLEQQEVQLELTPVELGAQQQEVQLELTPVQPELQLELVPAAGGGGAAVPGAPAAVVVAPPGYVVVQELMVLPAVAAPAVVAIPGPAGSAALTPARQRRRRRARDRPTICGECGKGFSRSTDLVRHQATHTGERPHRCGECGKGFSQHSNLVTHQRIHTGEKPYACSYCAKRFSESSALVQHQRTHTGERPYACGDCGKRFSVSSNLLRHRRTHSGERPYVCEDCGERFRHKVQIRRHERQLHGAGRSRGLGLLRASRPAALGGPARAEQAATATAPADKAL

SEQ ID NO: 16465 - protein, 632 aa, Homo Sapiens
MLREEAAQKRKEKEPGMALPQGHLTFRDVAIEFSLEEWKCLDPTQRALYRAMMLENYRNLHSVDISSKCMMKKFSSTAQGNTEVDTGTLERHESHHIGDFCFQKIGKDIHDFEFQWQEDKRNSHEATMTQIKKLTGSTDRYDRRHPGNKPIKDQLGLSFHSHLPELHIFQTKGKVGNQVEKSINDASSVLTSQRISSRPKIHISNNYENNFFHSSLLTLKQEVHIREKSFQCNESGKAFNCSSLLRKHQIIYLGGKQYKCDVCGKVFNQKRYLACHHRCHTGEKPYKCNECGKVFNQQSNLASHHRLHTGEKPYKCEECDKVFSRKSNLERHRRIHTGEKPYKCKVCEKAFRRDSHLTQHTRIHTGEKPYKCNECGKAFSGQSTLIHHQAIHGIGKLYKCNDCHKVFSNATTIANHWRIHNEERSYKCNKCGKFFRRRSYLVVHWRTHTGEKPYKCNECGKTFHHNSALVIHKAIHTGEKPYKCNECGKTFRHNSALVIHKAIHTGEKPYKCNECGKVFNQQATLARHHRLHTGEKPYKCEECDTVFSRKSHHETHKRIHTGEKPYKCDDFDEAFSQASSYAKQRRIHMGEKHHKCDDCGKAFTSHSHRIRHQRIHTGQKSYKCHKRGKVFS

SEQ ID NO: 16466 - protein, 203 aa, Homo Sapiens
MHTGEKPYTCEECVKLLTNPQALLYTGAFILNKNFTNVKNAAKPLLNPHPLINKRIHTGEKPYTCEECGKAFYRSSHLTEHKNIHTGEKSYKCEECGNAFYRSSHLTKHKRIHSGQKPYKCEECGKAFRQSSALNEHKKIHTAEKPYKCKECGKAFRWSRSLNEHTNIHIGEKPYTCEECGKDFTWSSTLTVHQRIQTGEKHS

SEQ ID NO: 16467 - protein, 531 aa, Homo Sapiens
MDSVAFEDVAVNFTQEEWALLDPSQKNLYREVMQETLRNLTSIGKKWNNQYIEDEHQNPRRNLRRLIGERLSESKESHQHGEVLTQVPDDTLKKKTPGVQSYESSVCGEIGIGLSSLNRHLRAFSYSSSLAIHGRTHTGEKPYECKECGKAFRFPSSVRRHERIHSAKKPYECKQCGKAFSFPSSVRRHERIHSAKKPYECKQCGKALSYLVSFQTHMRMHTGERPHKCNICGKAFFSPSSLKRHEKSHTGEKRYKCKQCDKAFNCPSSFQYHERTHSGEKPYECTQCRKAFRSVKYLRVHERKHTGEKPYECKLCGKGFISSTSFRYHEKTHTGEKPYECKKCVKAFSFVKDLRIHERTHTGEKPFECKQCGKTFTSSNSFHYHERTHTGEKPYECKQCGKAFRSASVLQKHIRTHTGEKPYGCKQCGKVFRVASQLKMHERTHTGEKPYECKQCGKAFISSNSIRYHKRTHTGEKPYKCKQCGKAFISSNSFLYHERIHTGEKPYECKQCGKAFRSASILQKHVRTHAG

SEQ ID NO: 16468 - protein, 563 aa, Homo Sapiens
MARRLLPAHVQESVTFRDVAVFFSQDEWLHLDSAQRALYREVMLENYSILVSLGILFSKPKVISQLEQGEDPWMVESGVPQGAHLGWESLFGTIVSKEENQEVMKKLIIDGTFDFKLEKTYINEDKLEKQQGKKNRLFSKVLVTIKKVYMKERSFKGVEFGKNLGLKSSLIRKPRIVSRGRRPRSQQYSVLFKQLGVNTVRKCYKCNICGKIFLHSSSLSKHQRIHTGEKLYKCKECRKAFSQSSSLTQHLRVHTGEKPYICSECGKAFSFTTSLIGHQRMHTGERPYKCKECGKTFKGSSSLNNHQRIHTGEKPYKCNECGRAFSQCSSLIQHHRIHTGEKPYECTQCGKAFTSISRLSRHHRIHTGEKPFHCNECGKVFSYHSALIIHQRIHTGEKPYACKECGKAFSQSSALIQHQRIHTGEKPYKCNECGKAFSWISRLNIHHRIHTGEKPYNCKECGKAFSSHSGVNTHRKIHTGEKPYKCNDCEKAFNQSSALIQHQRIHTGEKPYNCKVCGKAFRQSSSLMTHMRIHTGEKPYKCKECGKAFSQSSSLTNHQRTHN

SEQ ID NO: 16469 - protein, 577 aa, Homo Sapiens
MLRRGHLAFRDVAIEFPQEEWKCLDPAQRTLYREVMVENYRNLVFLGICLPDLSVISMLEQRRDPRNLQSEVKIANNPGGRECIKGVNAESSSKLGSNAGNKSLKNQLGLTFQLHLSELQLFQAERNISGCKHVEKPINNSLVSPLQKIYSSVKSHILNKYRNDFDDSPFLPQEQKAQIREKPCECNEHGKAFRVSSRLANNQVIHTADNPYKCNECDKVFSNSSNLVQHQRIHTGEKPYKCHECGKLFNRISLLARHQRIHTGEKPYKCHECGKVFTQNSHLANHHRIHTGEKPYKCNECGKVFNRNAHLARHQKIHSGEKPYKCKECGKAFSGGSGLTAHLVIHTGEKLYKCNKCGKVFNRNAHLTRHQRIHTGEKPYECKECGKVFRHKFCLTNHHRMHTGEQPYKCNECGKAFRDCSGLTAHLLIHTGEKPYKCKECAKVFRHRLSLSNHQRFHTGEKPYRCDECGKDFTRNSNLANHHRIHTGEKPYKCSECHKVFSHNSHLARHRQIHTGEKSYKCNECGKVFSHKLYLKKHERIHTGEKPYRCHECGKDFTRNSNLANHHRIHTGEKPYR

SEQ ID NO: 16470 - protein, 544 aa, Homo Sapiens
MAVMDLSSPWALTKQDSACFHLRNAEEERMIAVFLTTWLQEPMTFKDVAVEFTQEEWMMLDSAQRSLYRDVMLENYRNLTSVEYQLYRLTVISPLDQEEIRNMKKRIPQAICPDQKIQPKTKESTVQKILWEEPSNAVKMIKLTMHNWSSTLREDWECHKIRKQHKIPGGHWRQMIYAPKKTVPQELFRDYHELEENSKLGSKLIFSQSIFTSKHCQKCYSEIGCLKHNSIINNYVKNSISEKLYESHECDTTLWHFQRNQTVQKEYTYSKHGMHFTHNMFPVPNNLHMAQNACECNKDETLCHQSSLKKQGQTHTEKKHECNQCGKAFKRISNLTLYKKSHMGEKQYECKECGKVFNDSSTLRRHVRTHTGEKPYECNQCGKAFSQKTSLKAHMRTHTGEKPYECNQCGKSFGTSSYLIVHKRIHTGEKLYECSECGKAFNTSSHLKVHKKIHTGENVYECSDCGKVFSGVSSLRMHIRTHTGEKPYECKECRKAFSVSSSLRRHVRIHTGEKPYECIQCGKAFSQSSSLIIHKRIHTERETL

SEQ ID NO: 16471 - protein, 601 aa, Homo Sapiens
MGPLEFRDVAIEFSLEEWHCLDTAQQNLYRDVMLENYRHLVFLGIVVTKPDLITCLEQGKKPFTVKRHEMIAKSPVMCFHFAQDLCPEQSLKDSFQKVIVTRYEKREYGNLELKKGCESVDEGKVHKRGYNGLNQCLTATQSKVFQCDTYVKVSHIFSNSNRHKIRDTGKKPFKCIECGKAFNQSSTLATHKKIHTGEITCKCEECGKAFNRSSHLTSHKRIHTGEKRYKCEDCGKELKYSSTLTAHKRIHTGEKRYKCEDCGKELKYSSTLTAHKRIHTGEKPYKCDKCGRAFISSSILYVHKISHTEEKPYKCEECGKAFKLSSILSTHKRIHTGEKPYKCEECGKAFRRSLVLRTHKRIHTGEKPYKCDKCGKAFISSSLLYKHKISHSEKKPYKCEECGKAFKRSSTLTIHKISHTEEKPYKCQECDKVFKRSSALSTHKIIHSGEKPYKCEECGKAFKRSSNLTTHKISHTEEKLYKCQECDKAFKYSSALSTHKIIHSGENPYKCEECGKAFKRSSVLSKHKIIHTGAKPYKCEECGKAFKRSSQLTSHKISHTGEKPYKCEECGKAFNLSSDLNTHKRIHIGQKAYIVKNMANL

SEQ ID NO: 16472 - protein, 1191 aa, Homo Sapiens
MPGTPGSLEMGLLTFRDVAIEFSPEEWQCLDTAQQNLYRNVMLENYRNLAFLGIALSKPDLITYLEQGKEPWNMKQHEMVDEPTGICPHFPQDFWPEQSMEDSFQKVLLRKYEKCGHENLQLRKGCKSVDECKVHKEGYNKLNQCLTTAQSKVFQCGKYLKVFYKFLNSNRHTIRHTGKKCFKCKKCVKSFCIRLHKTQHKCVYITEKSCKCKECEKTFHWSSTLTNHKEIHTEDKPYKCEECGKAFKQLSTLTTHKIICAKEKIYKCEECGKAFLWSSTLTRHKRIHTGEKPYKCEECGKAFSHSSTLAKHKRIHTGEKPYKCEECGKAFSRSSTLAKHKRIHTGEKPYKCKECGKAFSNSSTLANHKITHTEEKPYKCKECDKAFKRLSTLTKHKIIHAGEKLYKCEECGKAFNRSSNLTIHKFIHTGEKPYKCEECGKAFNWSSSLTKHKRFHTREKPFKCKECGKAFIWSSTLTRHKRIHTGEKPYKCEECGKAFRQSSTLTKHKIIHTGEKPYKFEECGKAFRQSLTLNKHKIIHSREKPYKCKECGKAFKQFSTLTTHKIIHAGKKLYKCEECGKAFNHSSSLSTHKIIHTGEKSYKCEECGKAFLWSSTLRRHKRIHTGEKPYKCEECGKAFSHSSALAKHKRIHTGEKPYKCKECGKAFSNSSTLANHKITHTEEKPYKCKECDKTFKRLSTLTKHKIIHAGEKLYKCEECGKAFNRSSNLTIHKFIHTGEKPYKCEECGKAFNWSSSLTKHKRIHTREKPFKCKECGKAFIWSSTLTRHKRIHTGEKPYKCEECGKAFSRSSTLTKHKTIHTGEKPYKCKECGKAFKHSSALAKHKIIHAGEKLYKCEECGKAFNQSSNLTTHKIIHTKEKPSKSEECDKAFIWSSTLTEHKRIHTREKTYKCEECGKAFSQPSHLTTHKRMHTGEKPYKCEECGKAFSQSSTLTTHKIIHTGEKPYKCEECGKAFRKSSTLTEHKIIHTGEKPYKCEECGKAFSQSSTLTRHTRMHTGEKPYKCEECGKAFNRSSKLTTHKIIHTGEKPYKCEECGKAFISSSTLNGHKRIHTREKPYKCEECGKAFSQSSTLTRHKRLHTGEKPYKCGECGKAFKESSALTKHKIIHTGEKPYKCEKCGKAFNQSSILTNHKKIHTITPVIPLLWEAEAGGSRGQEMETILANTVKPLLY

SEQ ID NO: 16473 - protein, 586 aa, Homo Sapiens
MGPLTFRDVKIEFSLEEWQCLDTAQRNLYRDVMLENYRNLVFLGIAVSKPDLITWLEQGKEPWNLKRHEMVDKTPVMCSHFAQDVWPEHSIKDSFQKVILRTYGKYGHENLQLRKDHKSVDACKVYKGGYNGLNQCLTTTDSKIFQCDKYVKVFHKFPNVNRNKIRHTGKKPFKCKNRGKSFCMLSQLTQHKKIHTREYSYKCEECGKAFNWSSTLTKHKIIHTGEKPYKCEECGKAFNRSSNLTKHKIIHTGEKPYKCEECGKAFNRSSTLTKHKRIHTEEKPYKCEECGKAFNQFSILNKHKRIHMEDKPYKCEECGKAFRVFSILKKHKIIHTGEKPYKCEECGKAFNQFSNLTKHKIIHTGEKPYKCDECGKAFNQSSTLTKHKRIHTGEKPYKCEECGKAFKQSSTLTEHKIIHTGEKPYKCEKCGKAFSWSSAFTKHKRNHMEDKPYKCEECGKAFSVFSTLTKHKIIHTREKPYKCEECGKAFNQSSIFTKHKIIHTEGKSYKCEKCGNAFNQSSNLTARKIIYTGEKPYKYEECDKAFNKFSTLITHQIIYTGEKPCKHECGRAFNKSSNYTKEKLQT

SEQ ID NO: 16474 - protein, 620 aa, Homo Sapiens
MGPLQFRDVAIEFSLEEWHCLDTAQRNLYRNVMLENYSNLVFLGIVVSKPDLIAHLEQGKKPLTMKRHEMVANPSVICSHFAQDLWPEQNIKDSFQKVILRRYEKRGHGNLQLIKRCESVDECKVHTGGYNGLNQCSTTTQSKVFQCDKYGKVFHKFSNSNRHNIRHTEKKPFKCIECGKAFNQFSTLITHKKIHTGEKPYICEECGKAFKYSSALNTHKRIHTGEKPYKCDKCDKAFIASSTLSKHEIIHTGKKPYKCEECGKAFNQSSTLTKHKKIHTGEKPYKCEECGKAFNQSSTLTKHKKIHTGEKPYVCEECGKAFKYSRILTTHKRIHTGEKPYKCNKCGKAFIASSTLSRHEFIHMGKKHYKCEECGKAFIWSSVLTRHKRVHTGEKPYKCEECGKAFKYSSTLSSHKRSHTGEKPYKCEECGKAFVASSTLSKHEIIHTGKKPYKCEECGKAFNQSSSLTKHKKIHTGEKPYKCEECGKAFNQSSSLTKHKKIHTGEKPYKCEECGKAFNQSSTLIKHKKIHTREKPYKCEECGKAFHLSTHLTTHKILHTGEKPYRCRECGKAFNHSATLSSHKKIHSGEKPYECDKCGKAFISPSSLSRHEIIHTGEKP

SEQ ID NO: 16475 - protein, 572 aa, Homo Sapiens; identical to SEQ ID NO: 14458

SEQ ID NO: 16476 - protein, 864 aa, Homo Sapiens
MGSLTFWDVTIEFALEEWQCLDMAQQNLYRNVMLENYRNLVFLGIAVSKLDLITCLKQGKEPWNMKRHEMVTKPPVISSHFTQDFWPDQSIKDSFQEIILRTYARCGHKNLRLRKDCESVNEGKMHEEAYNKLNQCWTTTQGKIFQCNKYVKVFHKYSNSNRYKIRHTKKKTFKCMKCSKSFFMLSHLIQHKRIHTRENIYKCEERGKAFKWFSTLIKHKIIHTEDKPYKYKKCGKAFNISSMFTKCKIIHTGKKPCKCEECGKVFNNSSTLMKHKIIHTGKKPYKCEECGKAFKQSSHLTRHKAIHTGEKPYKCEECGKAFNHFSALRKHQIIHTGKKPYKCEECGKAFSQSSTLRKHEIIHTEEKPYKYEECGKAFSNLSALRKHEIIHTGQKPYKCEECGKAFKWSSKLTVHKVIHTAEKPCKCEECGKAFKRFSALRKHKIIHTGKQPYKCEECSKAFSNFSALRKHEIIHTGEKPYKCEECGKAFKWSSKLTVHKVIHMEEKPCKCEECGKAFKHFSALRKHKIIHTGKKPYKCEECGKAFNNSSTLMKHKIIHTGKKPYKCEECGKAFKQSSHLTRHKAIHTGEKPYKCEECGKAFNHFSALRKHQIIHTGKKPYKCEECGKAFSQSSTLRKHEIIHTGEKPYKCEECGKAFKWSSHLTRHKVIHTEEKPYKCEECGKAFNHFSALRKHKIIHTGKKPYKCEECGKAFSQSSTLRKHEIIHTGEKPYKCEECGKAFKWSSKLTVHKVIHTAEKPCKCEECGKAFKHFSALRKHKIIHTGKKPYKCEECGKAFNNSSTLRKHEIIHTGEKSYKCEECGKAFQWSSKLTLHKVIHMERNPANVKNVAKLLNISQPLENMR

SEQ ID NO: 16477 - protein, 1918 aa, Homo Sapiens
MEERRPHLDARPRNSHTNHRGPVDGELPPRARNQANNPPANALRGGASHPGRHPRANNHPAAYWQREERFRAMGRNPHQGRRNQEGHASDEARDQRHDQENDTRWRNGNQDCRNRRPPWSNDNFQQWRTPHQKPTEQPQQAKKLGYKFLESLLQKDPSEVVITLATSLGLKELLSHSSMKSNFLELICQVLRKACSSKMDRQSVLHVLGILKNSKFLKVCLPAYVVGMITEPIPDIRNQYPEHISNIISLLQDLVSVFPASSVQETSMLVSLLPTSLNALRASGVDIEEETEKNLEKVQTIIEHLQEKRREGTLRVDTYTLVQPEAEDHVESYRTMPIYPTYNEVHLDERPFLRPNIISGKYDSTAIYLDTHFRLLREDFVRPLREGILELLQSFEDQGLRKRKFDDIRIYFDTRIITPMCSSSGIVYKVQFDTKPLKFVRWQNSKRLLYGSLVCMSKDNFETFLFATVSNREQEDLCRGIVQLCFNEQSQQLLAEVQPSDSFLMVETTAYFEAYRHVLEGLQEVQEEDVPFQRNIVECNSHVKEPRYLLMGGRYDFTPLIENPSATGEFLRNVEGLRHPRINVLDPGQWPSKEALKLDDSQMEALQFALTRELAIIQGPPGTGKTYVGLKIVQALLTNESVWQISLQKFPILVVCYTNHALDQFLEGIYNCQKTSIVRVGGRSNSEILKQFTLRELRNKREFRRNLPMHLRRAYMSIMTQMKESEQELHEGAKTLECTMRGVLREQYLQKYISPQHWESLMNGPVQDSEWICFQHWKHSMMLEWLGLGVGSFTQSVSPAGPENTAQAEGDEEEEGEEESSLIEIAEEADLIQADRVIEEEEVVRPQRRKKEESGADQELAKMLLAMRLDHCGTGTAAGQEQATGEWQTQRNQKKKMKKRVKDELRKLNTMTAAEANEIEDVWQLDLSSRWQLYRLWLQLYQADTRRKILSYERQYRTSAERMAELRLQEDLHILKDAQVVGMTTTGAAKYRQILQKVEPRIVIVEEAAEVLEAHTIATLSKACQHLILIGDHQQLRPSANVYDLAKNFNLEVSLFERLVKVNIPFVRLNYQHRMCPEIARLLTPHIYQDLENHPSVLKYEKIKGVSSNLFFVEHNFPEQEIQEGKSHQNQHEAHFVVELCKYFLCQEYLPSQITILTTYTGQLFCLRKLMPAKTFAGVRVHVVDKYQGEENDIILLSLVRSNQEGKVGFLQISNRICVALSRAKKGMYCIGNMQMLAKVPLWSKIIHTLRENNQIGPMLRLCCQNHPETHTLVSKASDFQKVPEGGCSLPCEFRLGCGHVCTRACHPYDSSHKEFQCMKPCQKVICQEGHRCPLVCFQECQPCQVKVPKTIPRCGHEQMVPCSVPESDFCCQEPCSKSLRCGHRCSHPCGEDCVQLCSEMVTIKLKCGHSQPVKCGHVEGLLYGGLLVKCTTKCGTILDCGHPCPGSCHSCFEGRFHERCQQPCKRLLICSHKCQEPCIGECPPCQRTCQNRCVHSQCKKKCGELCSPCVEPCVWRCQHYQCTKLCSEPCNRPPCYVPCTKLLVCGHPCIGLCGEPCPKKCRICHMDEVTQIFFGFEDEPDARFVQLEDCSHIFEVQALDRYMNEQKDDEVAIRLKVCPICQVPIRKNLRYGTSIKQRLEEIEIIKEKIQGSAGEIATSQERLKALLERKSLLHQLLPEDFLMLKEKLAQKNLSVKDLGLVENYISFYDHLASLWDSLKKMHVLEEKRVRTRLEQVHEWLAKKRLSFTSQELSDLRSEIQRLTYLVNLLTRYKIAEKKVKDSIAVEVYSVQNILEKTCKFTQEDEQLVQEKMEALKATLPCSGLGISEEERVQIVSAIGYPRGHWFKCRNGHIYVIGDCGGAMERGTCPDCKEVIGGTNHTLERSNQLASEMDGAQHAAWSDTANNLMNFEEIQGMM

SEQ ID NO: 16478 - protein, 408 aa, Homo Sapiens
MLPRPKAPASPRRPQTPTPSEQDADPGPASPRDTEAQRLRFRQFQYHVASGPHLALGQLWTLCRQWLRPEARSKEQMLELLVLEQFLGALPSKMRTWVQSQGPRSCREAASLVEDLTQMCQQEVLVSLDSVEPQDWSFGEEEDGKSPRSQKEPSQASELILDAVAAAPALPEESEWLETTQLQQSLHTRAEAEAPRAPGLLGSRARLPLKPSIWDEPEDLLAGPSSDLRAEGTVISSPKGPSAQRISPRRRNRNTDQSGRHQPSLKHTKGGTQEAVAGISVVPRGPRGGRPFQCADCGMVFTWVTHFIEHQKTHREEGPFPCPECGKVFLHNSVLTEHGKIHLLEPPRKKAPRSKGPRESVPPRDGAQGPVAPRSPKRPFQCSVCGKAFPWMVHLIDHQKLHTAHGHM

SEQ ID NO: 16479 - protein, 725 aa, Homo Sapiens
MGPRASLSRLRELCGHWLRPALHTKKQILELLVLEQFLSVLPPHLLGRLQGQPLRDGEEVVLLLEGIHREPSHAGPLDFSCNAGKSCPRADVTLEEKGCASQVPSHSPKKELPAEEPSVLGPSDEPPRPQPRAAQPAEPGQWRLPPSSKQPLSPGPQKTFQALQESSPQGPSPWPEESSRDQELAAVLECLTFEDVPENKAWPAHPLGFGSRTPDKEEFKQEEPKGAAWPTPILAESQADSPGVPGEPCAQSLGRGAAASGPGEDGSLLGSSEILEVKVAEGVPEPNPELQFICADCGVSFPQLSRLKAHQLRSHPAGRSFLCLCCGKSFGRSSILKLHMRTHTDERPHACHLCGHRFRQSSHLSKHLLTHSSEPAFLCAECGRGFQRRASLVQHLLAHAQDQKPPCAPESKAEAPPLTDVLCSHCGQSFQRRSSLKRHLRIHARDKDRRSSEGSGSRRRDSDRRPFVCSDCGKAFRRSEHLVAHRRVHTGERPFSCQACGRSFTQSSQLVSHQRVHTGEKPYACPQCGKRFVRRASLARHLLTHGGPRPHHCTQCGKSFGQTQDLARHQRSHTGEKPCRCSECGEGFSQSAHLARHQRIHTGEKPHACDTCGHRFRNSSNLARHRRSHTGERPYSCQTCGRSFRRNAHLRRHLATHAEPGQEQAEPPQECVECGKSFSRSCNLLRHLLVHTGARPYSCTQCGRSFSRNSHLLRHLRTHARETLY

SEQ ID NO: 16480 - protein, 604 aa, Homo Sapiens
MASTWAIQAHMDQDEPLEVKIEEEKYTTRQDWDLRKNNTHSREVFRQYFRQFCYQETSGPREALSRLRELCHQWLRPETHTKEQILELLVLEQFLTILPEELQAWVQEQHPESGEEVVTVLEDLERELDEPGEQVSVHTGEQEMFLQETVRLRKEGEPSMSLQSMKAQPKYESPELESQQEQVLDVETGNEYGNLKQEVSEEMEPHGKTSSKFENDMSKSARCGETREPEEITEEPSACSREDKQPTCDENGVSLTENSDHTEHQRICPGEESYGCDDCGKAFSQHSHLIEHQRIHTGDRPYKCEECGKAFRGRTVLIRHKIIHTGEKPYKCNECGKAFGRWSALNQHQRLHTGEKHYHCNDCGKAFSQKAGLFHHIKIHTRDKPYQCTQCNKSFSRRSILTQHQGVHTGAKPYECNECGKAFVYNSSLVSHQEIHHKEKCYQCKECGKSFSQSGLIQHQRIHTGEKPYKCDVCEKAFIQRTSLTEHQRIHTGERPYKCDKCGKAFTQRSVLTEHQRIHTGERPYKCDECGNAFRGITSLIQHQRIHTGEKPYQCDECGKAFRQRKKTSYKEILLKNHSEPQAGVNLLLSSLIPEWQSCFRRDL

SEQ ID NO: 16481 - protein, 348 aa, Homo Sapiens
MTTALEPEDQKGLLIIKAEDHYWGQDSSSQKCSPHRRELYRQHFRKLCYQDAPGPREALTQLWELCRQWLRPECHTKEQILDLLVLEQFLSILPKDLQAWVRAHHPETGEEAVTVLEDLERELDEPGKQVPGNSERRDILMDKLAPLGRPYESLTVQLHPKKTQLEQEAGKPQRNGDKTRTKNEELFQKEDMPKDKEFLGEINDRLNKDTPQHPKSKDIIENEGRSEWQQRERRRYKCDECGKSFSHSSDLSKHRRTHTGEKPYKCDECGKAFIQRSHLIGHHRVHTGVKPYKCKECGKDFSGRTGLIQHQRIHTGEKPYECDECGRPFRVSSALIRHQRIHTANKLY

SEQ ID NO: 16482 - protein, 510 aa, Homo Sapiens
MLPLEKAFASPRSSPAPPDLPTPGSAAGVQQEEPETIPERTPADLEFSRLRFREFVYQEAAGPHQTLARLHELCRQWLMPEARSKEQMLELLVLEQFLGILPDKVRPWVVAQYPESCKKAASLVEGLADVLEEPGMLLGSPAGSSSILSDGVYERHMDPLLLPGELASPSQALGAGEIPAPSETPWLSPDPLFLEQRRVREAKTEEDGPANTEQKLKSFPEDPQHLGEWGHLDPAEENLKSYRKLLLWGYQLSQPDAASRLDTEELRLVERDPQGSSLPEGGRRQESAGCACEEAAPAGVLPELPTEAPPGDALADPPSGTTEEEEEQPGKAPDPQDPQDAESDSATGSQRQSVIQQPAPDRGTAKLGTKRPHPEDGDGQSLEGVSSSGDSAGLEAGQGPGADEPGLSRGKPYACGECGEAFAWLSHLMEHHSSHGGRKRYACQGCWKTFHFSLALAEHQKTHEKEKSYALGGARGPQPSTREAQAGARAGGPPESVEGEAPPAPPEAQR

SEQ ID NO: 16483 - protein, 614 aa, Homo Sapiens
MMAADIPRVTTPLSSLVQVPQEEDRQEEEVTTMILEDDSWVQEAVLQEDGPESEPFPQSAGKGGPQEEVTRGPQGALGRLRELCRRWLRPEVHTKEQMLTMLPKEIQAWLQEHRPESSEEAAALVEDLTQTLQDSDFEIQSENGENCNQDMFENESRKIFSEMPEGESAQHSDGESDFERDAGIQRLQGHSPGEDHGEVVSQDREVGQLIGLQGTYLGEKPYECPQCGKTFSRKSHLITHERTHTGEKYYKCDECGKSFSDGSNFSRHQTTHTGEKPYKCRDCGKSFSRSANLITHQRIHTGEKPFQCAECGKSFSRSPNLIAHQRTHTGEKPYSCPECGKSFGNRSSLNTHQGIHTGEKPYECKECGESFSYNSNLIRHQRIHTGEKPYKCTDCGQRFSQSSALITHRRTHTGEKPYQCSECGKSFSRSSNLATHRRTHMVEKPYKCGVCGKSFSQSSSLIAHQGMHTGEKPYECLTCGESFSWSSNLLKHQRIHTGEKPYKCSECGKCFSQRSQLVVHQRTHTGEKPYKCLMCGKSFSRGSILVMHQRAHLGDKPYRCPECGKGFSWNSVLIIHQRIHTGEKPYKCPECGKGFSNSSNFITHQRTHMKEKLY

SEQ ID NO: 16484 - protein, 1043 aa, Homo Sapiens
MAMALELQAQASPQPEPEELLIVKLEEDSWGSESKLWEKDRGSVSGPEASRQRFRQFQYRDAAGPHEAFSQLWALCCRWLRPEIRLKEQILELLVLEQFLTILPREVQTWVQARHPESGEEAVALVEDWHRETRTAGQSGLELHTEETRPLKTGEEAQSFQLQPVDPWPEGQSQKKGVKNTCPDLPNHLNAEVAPQPLKESAVLTPRVPTLPKMGSVGDWEVTAESQEALGPGKHAEKELCKDPPGDDCGNSVCLGVPVSKPSNTSEKEQGPEFWGLSLINSGKRSTADYSLDNEPAQALTWRDSRAWEEQYQWDVEDMKVSGVHWGYEETKTFLAILSESPFSEKLRTCHQNRQVYRAIAEQLRARGFLRTLEQCRYRVKNLLRNYRKAKSSHPPGTCPFYEELEALVRARTAIRATDGPGEAVALPRLGYSDAEMDEQEEGGWDPEEMAEDCNGAGLVNVESTQGPRIAGAPALFQSRIAGVHWGYEETKAFLAILSESPFSEKLRTCHQNSQVYRAIAERLCALGFLRTLEQCRYRFKNLLRSYRKAKSSHPPGTCPFYEELDSLMRARAAVRAMGTVREAAGLPRCGQSSAETDAQEAWGEVANEDAVKPSTLCPKAPDMGFEMRHEDEDQISEQDIFEGLPGALSKCPTEAVCQPLDWGEDSENENEDEGQWGNPSQEQWQESSSEEDLEKLIDHQGLYLAEKPYKCDTCMKSFSRSSHFIAHQRIHTGEKPYKCLECGKNFSDRSNLNTHQRIHTGEKPYKCLECGKSFSDHSNLITHQRIHTGEKPYKCGECWKSFNQSSNLLKHQRIHLGGNPDQCSEPGGNFAQSPSFSAHWRNSTEETAPEQPQSISKDLNSPGPHSTNSGEKLYECSECGRSFSKSSALISHQRIHTGEKPYECAECGKSFSKSSTLANHQRTHTGEKPYKCVDCGKCFSERSKLITHQRVHTGEKPYKCLECGKFFRDRSNLITHQRIHTGEKPYKCRECGKCFNQSSSLIIHQRIHTGEKPYKCTECGKDFNNSSHFSAHRRTHAGGKAS

SEQ ID NO: 16485 - protein, 473 aa, Homo Sapiens
MMTKVLGMAPVLGPRPPQEQVGPLMVKVEEKEEKGKYLPSLEMFRQRFRQFGYHDTPGPREALSQLRVLCCEWLRPEIHTKEQILELLVLEQFLTILPQELQAWVQEHCPESAEEAVTLLEDLERELDEPGHQVSTPPNEQKPVWEKISSSGTAKESPSSMQPQPLETSHKYESWGPLYIQESGEEQEFAQDPRKVRDCRLSTQHEESADEQKGSEAEGLKGDIISVIIANKPEASLERQCVNLENEKGTKPPLQEAGSKKGRESVPTKPTPGERRYICAECGKAFSNSSNLTKHRRTHTGEKPYVCTKCGKAFSHSSNLTLHYRTHLVDRPYDCKCGKAFGQSSDLLKHQRMHTEEAPYQCKDCGKAFSGKGSLIRHYRIHTGEKPYQCNECGKSFSQHAGLSSHQRLHTGEKPYKCKECGKAFNHSSNFNKHHRIHTGEKPYWCHHCGKTFCSKSNLSKHQRVHTGEGEAP

SEQ ID NO: 16486 - protein, 491 aa, Homo Sapiens
MAIPKHSLSPVPWEEDSFLQVKVEEEEEASLSQGGESSHDHIAHSEAARLRFRHFRYEEASGPHEALAHLRALCCQWLQPEAHSKEQILELLVLEQFLGALPPEIQAWVGAQSPKSGEEAAVLVEDLTQVLDKRGWDPGAEPTEASCKQSDLGESEPSNVTETLMGGVSLGPAFVKACEPEGSSERSGLSGEIWTKSVTQQIHFKKTSGPYKDVPTDQRGRESGASRNSSSAWPNLTSQEKPPSEDKFDLVDAYGTEPPYTYSGKRSSKCRECRKMFQSASALEAHQKTHSRKTPYACSECGKAFSRSTHLAQHQVVHTGAKPHECKECGKAFSRVTHLTQHQRIHTGEKPYKCGECGKTFSRSTHLTQHQRVHTGERPYECDACGKAFSQSTHLTQHQRIHTGEKPYKCDACGRAFSDCSALIRHLRIHSGEKPYQCKVCPKAFAQSSSLIEHQRIHTGEKPYKCSDCGKAFSRSSALMVHLRIHITVLQ

SEQ ID NO: 16487 - protein, 389 aa, Homo Sapiens
MAITLTLQTAEMQEGLLAVKVKEEEEEHSCGPESGLSRNNPHTREIFRRRFRQFCYQESPGPREALQRLQELCHQWLRPEMHTKEQILELLVLEQFLTILPEELQAWVRQHRPVSGEEAVTVLEDLERELDDPGEQVLSHAHEQEEFVKEKATPGAAQESSNDQFQTLEEQLGYNLREVCPVQEIDGKAGTWNVELAPKREISQEVKSLIQVLGKQNGNITQIPEYGDTCDREGRLEKQRVSSSVERPYICSECGKSFTQNSILIEHQRTHTGEKPYECDECGRAFSQRSGLFQHQRLHTGEKRYQCSVCGKAFSQNAGLFHHLRIHTGEKPYQCNQCNKSFSRRSVLIKHQRIHTGERPYECEECGKNFIYHCNLIQHRKVHPVAESS

SEQ ID NO: 16488 - protein, 544 aa, Homo Sapiens
MLKEHPEMAEAPQQQLGIPVVKLEKELPWGRGREDPSPETFRLRFRQFRYQEAAGPQEALRELQELCRRWLRPELHTKEQILELLVLEQFLTILPREFYAWIREHGPESGKALAAMVEDLTERALEAKAVPCHRQGEQEETALCRGAWEPGIQLGPVEVKPEWGMPPGEGVQGPDPGTEEQLSQDPGDETRAFQEQALPVLQAGPGLPAVNPRDQEMAAGFFTAGSQGLGPFKDMALAFPEEEWRHVTPAQIDCFGEYVEPQDCRVSPGGGSKEKEAKPPQEDLKGALVALTSERFGEASLQGPGLGRVCEQEPGGPAGSAPGLPPPQHGAIPLPDEVKTHSSFWKPFQCPECGKGFSRSSNLVRHQRTHEEKSYGCVECGKGFTLREYLMKHQRTHLGKRPYVCSECWKTFSQRHHLEVHQRSHTGEKPYKCGDCWKSFSRRQHLQVHRRTHTGEKPYTCECGKSFSRNANLAVHRRAHTGEKPYGCQVCGKRFSKGERLVRHQRIHTGEKPYHCPACGRSFNQRSILNRHQKTQHRQEPLVQ

SEQ ID NO: 16489 - protein, 478 aa, Homo Sapiens
MATALVSAHSLAPLNLKKEGLRVVREDHYSTWEQGFKLQGNSKGLGQEPLCKQFRQLRYEETTGPREALSRLRELCQQWLQPETHTKEQILELLVLEQFLIILPKELQARVQEHHPESREDVVVVLEDLQLDLGETGQQDPDQPKKQKILVEEMAPLKGVQEQQVRHECEVTKPEKEKGEETRIENGKLIVVTDSCGRVESSGKISEPMEAHNEGSNLERHQAKPKEKIEYKCSEREQRFIQHLDLIEHASTHTGKKLCESDVCQSSSLTGHKKVLSREKGHQCHECGKAFQRSSHLVRHQKIHLGEKPYQCNECGKVFSQNAGLLEHLRIHTGEKPYLCIHCGKNFRRSSHLNRHQRIHSQEEPCECKECGKTFSQALLLTHHQRIHSHSKSHQCNECGKAFSLTSDLIRHHRIHTGEKPFKCNICQKAFRLNSHLAQHVRIHNEEKPYQCSECGEAFRQRSGLFQHQRYHHKDKLA

SEQ ID NO: 16490 - protein, 852 aa, Homo Sapiens; identical to SEQ ID NO: 14472

SEQ ID NO: 16491 - protein, 494 aa, Homo Sapiens
MSGEATVLAYHAPEEQEGLLVVKVEEENYVLDQDFGLQENPWSQEVFRQKFRQFSYSDSTGPREALSRLRELCCQWLRPEVHSKEQILELLMLEQFLAILPEELQAWLREHRPENGEEAVTMLEELEKELEEPRQQDTTHGQEMFWQEMTSTGALKSLSLNSPVQPLENQCKTETQESQAFQERDGRMVAGKVLMAKQEIVECVASAAMISPGKLPGETHSQRIAEEALGGLDNSKKQKGNAAGNKISQLPSQDRHFSLATFNRRIPTEHSVLESHESEGSFSMNSNDITQQSVDTREKLYECFDCGKAFCQSSKLIRHQRIHTGERPYACKECGKAFSLSSDLVRHQRIHSGEKPYECCECGKAFRGSSELIRHRRIHTGEKPYECGECGKAFSRSSALIQHKKIHTGDKSYECIACGKAFGRSSILIEHQRIHTGEKPYECNECGKSFNQSSALTQHQRIHTGEKPYECSECRKTFRHRSGLMQHQRTHTRV

SEQ ID NO: 16492 - protein, 406 aa, Homo Sapiens
MASTEEQYDLKIVKVEEDPIWDQETHLRGNNFSGQEASRQLFRQFCYQETPGPREALSRLRELCHQWLRPEIHTKEQILELLVLEQFLTILPEELQAWVREHHPESGEEAVAVVEDLEQELSEPGNQAPDHEHGHSEVLLEDVEHLKVKQEPTDIQLQPMVTQLRYESFCLHQFQEQDGESIPENQELASKQEILKEMEHLGDSKLQRDVSLDSKYRETCKRDSKAEKQQAHSTGERRHRCNECGKSFTKSSVLIEHQRIHTGEKPYECEECGKAFSRRSSLNEHRRSHTGEKPYQCKECGKAFSASNGLTRHRRIHTGEKPYECKVCGKAFLLSSCLVQHQRIHTGEKRYQCRECGKAFIQNAGLFQHLRVHTGEKPYQCSQCSKLFSKRTLLKKHQKIHTGERP

SEQ ID NO: 16493 - protein, 697 aa, Homo Sapiens
MMAAVKSTEAHPSSNKDPTQGQKSALQGNSPDSEASRQRFRQFCYQEVTGPHEAFSKLWELCCQWLRPKTHSKEEILELLVLEQFLTILPEEIQTWVREQHPENGEEAVALVEDVQRAPGQQVLDSEKDLKVLMKEMAPLGATRESLRSQWKQEVQPEEPTFKGSQSSHQRPGEQSEAWLAPQAPRNLPQNTGLHDQETGAVVWTAGSQGPAMRDNRAVSLCQQEWMCPGPAQRALYRGATQRKDSHVSLATGVPWGYEETKTLLAILSSSQFYGKLQTCQQNSQIYRAMAEGLWEQGFLRTPEQCRTKFKSLQLSYRKVRRGRVPEPCIFYEEMNALSGSWASAPPMASDAVPGQEGSDIEAGELNHQNGEPTEVEDGTVDGADRDEKDFRNPGQEVRKLDLPVLFPNRLGFEFKNEIKKENLKWDDSEEVEINKALQRKSRGVYWHSELQKGLESEPTSRRQCRNSPGESEEKTPSQEKMSHQSFCARDKACTHILCGKNCSQSVHSPHKPALKLEKVSQCPECGKTFSRSSYLVRHQRIHTGEKPHKCSECGKGFSERSNLTAHLRTHTGERPYQCGQCGKSFNQSSSLIVHQRTHTGEKPYQCIVCGKRFNNSSQFSAHRRIHTGESPYKCAVCGKIFNNSSHFSAHRKTHTGEKPYRCSHCERGFTKNSALTRHQTVHMKAVLSSQEGRDAL

SEQ ID NO: 16494 - protein, 433 aa, Homo Sapiens
MALDLRTIFQCEPSENNLGSENSAFQQSQGPAVQREEGISEFSRMVLNSFQDSNNSYARQELQRLYRIFHSWLQPEKHSKDEIISLLVLEQFMIGGHCNDKASVKEKWKSSGKNLERFIEDLTDDSINPPALVHVHMQGQEALFSEDMPLRDVIVHLTKQVNAQTTREANMGTPSQTSQDTSLETGQGYEDEQDGWNSSSKTTRVNENITNQGNQIVSLIIIQEENGPRPEEGGVSSDNPYNSKRAELVTARSQEGSINGITFQGVPMVMGAGCISQPEQSSPESALTHQSNEGNSTCEVHQKGSHGVQKSYKCEECPKVFKYLCHLLAHQRRHRNERPFVCPECQKGFFQISDLRVHQIIHTGKKPFTCSMCKKSFSHKTNLRSHERIHTGEKPYTCPFCKTSYRQSSTYHRHMRTHEKITLPSVPSTPEAS

SEQ ID NO: 16495 - protein, 496 aa, Homo Sapiens
MAANCTSSWSLGESCNRPGLELPRSMASSETQLGNHDVDPEISHVNFRMFSCPKESDPIQALRKLTELCHLWLRPDLHTKEQILDMLVMEQFMISMPQELQVLVMMNGVQSCKDLEDLLRNNRRPKKWSVVTFHGKEYIVQDSDIEMAEAPSSVRDDLKDVSSQRASSVNQMRPGEGQAHRELQILPRVPALSRRQGEDFLLHKSIDVTGDPKSLRPKQTLEKDLKENREENPGLTSPEPQLPKSPTDLVRAKEGKDPPKIASVENVDADTPSACVVEREASTHSGNRGDALNLSSPKRSKPDASSISQEEPQGEATPVGNRESPGQAGMNSIHSPGPASPVSHPDGQEAKALPPFACDVCEKRFTCNSKLVIHKRSHTGERLFQCNLCGKRFMQLISLQFHQRTHTGERPYTCDVCQKQFTQKSYLKCHKRSHTGEKPFECKDCKKVFTYRGSLKEHQRIHSGEKPYKCSKCPRAFSRLKLLRRHQKTHPEATSQ

SEQ ID NO: 16496 - protein, 495 aa, Homo Sapiens
MAANWTLSWGQGGPCNSPGSDTPRSVASPETQLGNHDRNPETWHMNFRMFSCPEESDPIQALRKLTELCHLWLRPDLHTKEQILDMLVMEQFMISMPQELQVLVKVNGVQSCKDLEDLLRNNRRPKKWSIVNLLGKEYLMLNSDVEMAEAPASVRDDPRDVSSQWASSVNQMHPGTGQARREQQILPRVAALSRRQGEDFLLHKSIDVTGDPNSPRPKQTLEKDLKENREENPGLSSPEPQLPKSPNLVRAKEGKEPQKRASVENVDADTPSACVVEREALTHSGNRGDALNLSSPKRSKPDASSISQEEPQGEATPVGNRESPGQAEINPVHSPGPAGPVSHPDGQEAKALPPFACDVCNKSFKYFSQLSIHRRSHTGDRPFQCDLCRKRFLQPSDLRVHQRVHTGERPYMCDVCQKRFAHESTLQGHKRIHTGERPFKCKYCSKVFSHKGNLNVHQRTHSGEKPYKCPTCQKAFRQLGTFKRHLKTHRETTSQ

SEQ ID NO: 16497 - protein, 496 aa, Homo Sapiens
MAANCTSSWSLGESCNSPGSEPPQSMPSPATQLGNHDSDPETCHVNFRMFSCPKESDPIQALRKLTELCHLWLRPDLHTKEQILDMLVMEQFMISMPQELQVLVMMNGVQSCKDLEDLLRNNRRPKKWSVVSFLGKEYLMQESDVEMAEAPASVRDDPRHVSSQRTSSVNQMCPEEGQASQELQTLPRVPALFRRQEEDFLLPETTVMKGDPKALRPKPTLEKDLEEDREENPGLTSPEPQLPNSPTGVVGAKEGKEPQKRASVENVDADTPSACVVEREASTHSGSRGDALNLRGLKRSKPDATSISQEEPQGEATPVGNRESPGQAEINPVHSPGPAGPVSHPSGQEVKELLPFACEVCGKRFKYRGKLAVHTRSHTGERLFQCNLCGKRFMQRIGLQFHQRTHTGERPYTCDICQKQFTQKSYLKCHKRSHTGEKPFECKDCKKVFTYKANLKEHQRIHSGEKPHKCSKCPRAFGRPATLRRHQKTHREATSQ

SEQ ID NO: 16498 - protein, 394 aa, Homo Sapiens
MNTNSKEVLSLGVQVPEAWEELLTMKVEAKSHLQWQESRLKRSNPLAREIFRRHFRQLCYQETPGPREALTRLQELCYQWLRPHVSTKEQILDLLVLEQFLSILPKELQGWVREHCPESGEEAVILLEDLERELDEPQHEMVAHRHRQEVLCKEMVPLAEQTPLTLQSQPKEPQLTCDSAQKCHSIGETDEVTKTEDRELVLRKDCPKIVEPHGKMFNEQTWEVSQQDPSHGEVGEHKDRIERQWGNLLGEGQHKCDECGKSFTQSSGLIRHQRIHTGERPYECNECGKAFSRSSGLFNHRGIHNIQKRYHCKECGKVFSQSAGLIQHQRIHKGEKPYQCSQCSKSYSRRSFLIEHQRSHTGERPHQCIECGKSFNRHCNLIRHQKIHTVAELV

SEQ ID NO: 16499 - protein, 578 aa, Homo Sapiens
MLSCNICGETVTSEPDMKAHLIVHMESEIICPFCKLSGVNYDEMCFHIETAHFEQNTLERNFERINTVQYGTSDNKKDNTLQCGMEVNSSILSGCASNHPKNSAQNLTKDSTLKHEGFYSENLTESRKFLKSREKQSSLTEIKGSVYETTYSPPECPFCGKIEEHSEDMETHVKTKHANLLDIPLEDCDQPLYDCPMCGLICTNYHILQEHVDLHLEENSFQQGMDRVQCSGDLQLAHQLQQEEDRKRRSEESRQEIEEFQKLQRQYGLDNSGGYKQQQLRNMEIEVNRGRMPPSEFHRRKADMMESLALGFDDGKTKTSGIIEALHRYYQNAATDVRRVWLSSVVDHFHSSLGDKGWGCGYRNFQMLLSSLLQNDAYNDCLKGMLIPCIPKIQSMIEDAWKEGFDPQGASQLNNRLQGTKAWIGACEVYILLTSLRVKCHIVDFHKSTGPLGTHPRLFEWILNYYSSEGEGSPKVVCTSKPPIYLQHQGHSRTVIGIEEKKNRTLCLLILDPGCPSREMQKLLKQDIEASSLKQLRKSMGNLKHKQYQILAVEGALSLEEKLARRQASQVFTAEKIP

SEQ ID NO: 16500 - protein, 799 aa, Homo Sapiens
MEIPKLLPARGTLQGGGGGGIPAGGGRVHRGPDSPAGQVPTRRLLLPRGPQDGGPGRRREEASTASRGPGPSLFAPRPHQPSGGGDDFFLVLLDPVGGDVETAGSGQAAGPVLREEAKAGPGLQGDESGANPAGCSAQGPHCLSAVPTPAPISAPGPAAAFAGTVTIHNQDLLLRFENGVLTLATPPPHAWEPGAAPAQQPRCLIAPQAGFPQAAHPGDCPELRSDLLLAEPAEPAPAPAPQEEAEGLAAALGPRGLLGSGPGVVLYLCPEALCGQTFAKKHQLKMHLLTHSSSQGQRPFKCPLGGCGWTFTTSYKLKRHLQSHDKLRPFGCPAEGCGKSFTTVYNLKAHMKGHEQENSFKCEVCEESFPTQAKLGAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDTLTPSSTLCENSVSELLTPAKAEWSVHPNSDFFGQEGETQFGFPNAAGNHGSQKERNLITVTGSSFLV

SEQ ID NO: 16501 - protein, 803 aa, Homo Sapiens
MEIPKLLPARGTLQGGGGGGIPAGGGRVHRGPDSPAGQVPTRRLLLLRGPQDGGPGRRREEASTASRGPGPSLLAPRTDQPSGGGGGGGDDFFLVLLDPVGGDVETAGSGQAAGPVLREEAEEGPGLQGGESGANPAGPTALGPRCLSAVPTPAPISAPGPAAAFAGTVTIHNQDLLLRFENGVLTLATPPPHAWEPGAAPAQQPGCLIAPQAGFPHAAHPGDCPELPPDLLLAEPAEPAPAPAPEEEAEGPAAALGPRGPLGSGPGVVLYLCPEAQCGQTFAKKHQLKVHLLTHSSSQGQRPFKCPLGGCGWTFTTSYKLKRHLQSHDKLRPFGCPAEGCGKSFTTVYNLKAHMKGHEQENSFKCEVCEESFPTQAKLSAHQRSHFEPERPYQCAFSGCKKTFITVSALFSHNRAHFREQELFSCSFPGCSKQYDKACRLKIHLRSHTGERPFLCDFDGCGWNFTSMSKLLRHKRKHDDDRRFMCPVEGCGKSFTRAEHLKGHSITHLGTKPFVCPVAGCCARFSARSSLYIHSKKHLQDVDTWKSRCPISSCNKLFTSKHSMKTHMVKRHKVGQDLLAQLEAANSLTPSSELTSQRQNDLSDAEIVSLFSDVPDSTSAALLDTALVNSGILTIDVASVSSTLAGHLPANNNNSVGQAVDPPSLMATSDPPQSLDTSLFFGTAATGFQQSSLNMDEVSSVSVGPLGSLDSLAMKNSSPEPQALTPSSKLTVDTDALTPSSTLCENSVSELLTPTKAEWNVHPDSDFFGQEGETQFGFPNAAGNHGSQKETDLITVTGSSFLV

SEQ ID NO: 16502 - protein, 858 aa, Homo Sapiens
MDLPALLPAPTARGGQHGGGPGPLRRAPAPLGASPARRRLLLVRGPEDGGPGARPGEASGPSPPPAEDDSDGDSFLVLLEVPHGGAAAEAAGSQEAEPGSRVNLASRPEQGPSGPAAPPGPGVAPAGAVTISSQDLLVRLDRGVLALSAPPGPATAGAAAPRRAPQASGPSTPGYRCPEPQCALAFAKKHQLKVHLLTHGGGQGRRPFKCPLEGCGWAFTTSYKLKRHLQSHDKLRPFGCPVGGCGKKFTTVYNLKAHMKGHEQESLFKCEVCAERFPTHAKLSSHQRSHFEPERPYKCDFPGCEKTFITVSALFSHNRAHFREQELFSCSFPGCSKQYDKACRLKIHLRSHTGERPFICDSDSCGWTFTSMSKLLRHRRKHDDDRRFTCPVEGCGKSFTRAEHLKGHSITHLGTKPFECPVEGCCARFSARSSLYIHSKKHVQDVGAPKSRCPVSTCNRLFTSKHSMKAHMVRQHSRRQDLLPQLEAPSSLTPSSELSSPGQSELTNMDLAALFSDTPANASGSAGGSDEALNSGILTIDVTSVSSSLGGNLPANNSSLGPMEPLVLVAHSDIPPSLDSPLVLGTAATVLQQGSFSVDDVQTVSAGALGCLVALPMKNLSDDPLALTSNSNLAAHITTPTSSSTPRENASVPELLAPIKVEPDSPSRPGAVGQQEGSHGLPQSTLPSPAEQHGAQDTELSAGTGNFYLESGGSARTDYRAIQLAKEKKQRGAGSNAGASQSTQRKIKEGKMSPPHFHASQNSWLCGSLVVPSGGRPGPAPAAGVQCGAQGVQVQLVQDDPSGEGVLPSARGPATFLPFLTVDLPVYVLQEVLPSSGGPAGPEATQFPGSTINLQDLQ

SEQ ID NO: 16503 - protein, 903 aa, Homo Sapiens
MAASRSTRVTRSTVGLNGLDESFCGRTLRNRSIAHPEEISSNSQVRSRSPKKRPEPVPIQKGNNNGRTTDLKQQSTRESWVSPRKRGLSSSEKDNIERQAIENCERRQTEPVSPVLKRIKRCLRSEAPNSSEEDSPIKSDKESVEQRSTVVDNDADFQGTKRACRCLILDDCEKREIKKVNVSEEGPLNSAVVEEITGYLAVNGVDDSDSAVINCDDCQPDGNTKQNSIGSYVLQEKSVAENGDTDTQTSMFLDSRKEDSYIDHKVPCTDSQVQVKLEDHKIVTACLPVEHVNQLTTEPATGPFSETQSSLRDSEEEVDVVGDSSASKEQCKENTNNELDTSLESMPASGEPEPSPVLDCVSAQMMSLSEPQEHRYTLRTSPRRAAPTRGSPTKNSSPYRENGQFEENNLSPNETNATVSDNVSQSPTNPGEISQNEKGICCDSQNNGSEGVSKPPSEARLNIGHLPSAKESASQHITEEEDDDPDVYYFESDHVALKHNKDYQRLLQTIAVLEAQRSQAVQDLESLGRHQREALKNPIGFVEKLQKKADIGLPYPQRVVQLPEIVWDQYTHSLGNFEREFKNRKRHTRRVKLVFDKVGLPARPKSPLDPKKDGESLSYSMLPLSDGPEGSSSRPQMIRGRLCDDTKPETFNQLWTVEEQKKLEQLLIKYPPEEVESRRWQKIADELGNRTAKQVASRVQKYFIKLTKAGIPVPGRTPNLYIYSKKSSTSRRQHPLNKHLFKPSTFMTSHEPPVYMDEDDDRSCFHSHMNTAVEDASDDESIPIMYRNLPEYKELLQFKKLKKQKLQQMQAESGFVQHVGFKCDNCGIEPIQGVRWHCQDCPPEMSLDFCDSCSDCLHETDIHKEDHQLEPIYRSETFLDRDYCVSQGTSYNYLDPNYFPANR

SEQ ID NO: 16504 - protein, 455 aa, Homo Sapiens; identical to SEQ ID NO: 13589

SEQ ID NO: 16505 - protein, 461 aa, Homo Sapiens; identical to SEQ ID NO: 13591

SEQ ID NO: 16506 - protein, 417 aa, Homo Sapiens; identical to SEQ ID NO: 13599

SEQ ID NO: 16507 - protein, 655 aa, Homo Sapiens
MGTSPSSSTALASCSRIARRATATMIAGSLLLLGFLSTTTAQPEQKASNLIGTYRHVDRATGQVLTCDKCPAGTYVSEHCTNTSLRVCSSCPVGTFTRHENGIEKCHDCSQPCPWPMIEKLPCAALTDRECTCPPGMFQSNATCAPHTVCPVGWGVRKKGTETEDVRCKQCARGTFSDVPSSVMKCKAYTDCLSQNLVVIKPGTKETDNVCGTLPSFSSSTSPSPGTAIFPRPEHMETHEVPSSTYVPKGMNSTESNSSASVRPKVLSSIQEGTVPDNTSSARGKEDVNKTLPNLQVVNHQQGPHHRHILKLLPSMEATGGEKSSTPIKGPKRGHPRQNLHKHFDINEHLPWMIVLFLLLVLVVIVVCSIRKSSRTLKKGPRQDPSAIVEKAGLKKSMTPTQNREKWIYYCNGHGIDILKLVAAQVGSQWKDIYQFLCNASEREVAAFSNGYTADHERAYAALQHWTIRGPEASLAQLISALRQHRRNDVVEKIRGLMEDTTQLETDKLALPMSPSPLSPSPIPSPNAKLENSALLTVEPSPQDKNKGFFVDESEPLLRCDSTSSGSSALSRNGSFITKEKKDTVLRQVRLDPCDLQPIFDDMLHFLNPEELRVIEEIPQAEDKLDRLFEIIGVKSQEASQTLLDSVYSHLPDLL

SEQ ID NO: 16508 - protein, 335 aa, Homo Sapiens; identical to SEQ ID NO: 5109

SEQ ID NO: 16509 - protein, 2511 aa, Homo Sapiens
MEEVVIAGMSGKLPESENLQEFWDNLIGGVDMVTDDDRRWKAGLYGLPRRSGKLKDLSRFDASFFGVHPKQAHTMDPQLRLLLEVTYEAIVDGGINPDSLRGTHTGVWVGVSGSETSEALSRDPETLVGYSMVGCQRAMMANRLSFFFDFRGPSIALDTACSSSLMALQNAYQAIHSGQCPAAIVGGINVLLKPNTSVQFLRLGMLSPEGTCKAFDTAGNGYCRSEGVVAVLLTKKSLARRVYATILNAGTNTDGFKEQGVTFPSGDIQEQLIRSLYQSAGVAPESFEYIEAHGTGTKVGDPQELNGITRALCATRQEPLLIGSTKSNMGHPEPASGLAALAKVLLSLEHGLWAPNLHFHSPNPEIPALLDGRLQVVDQPLPVRGGNVGINSFGFGGSNVHIILRPNTQPPPAPAPHATLPRLLRASGRTPEAVQKLLEQGLRHSQDLAFLSMLNDIAAVPATAMPFRGYAVLGGERGGPEVQQVPAGERPLWFICSGMGTQWRGMGLSLMRLDRFRDSILRSDEAVKPFGLKVSQLLLSTDESTFDDIVHSFVSLTAIQIGLIDLLSCMGLRPDGIVGHSLGEVACGYADGCLSQEEAVLAAYWRGQCIKEAHLPPGAMAAVGLSWEECKQRCPPGVVPACHNSKDTVTISGPQAPVFEFVEQLRKEGVFAKEVRTGGMAFHSYFMEAIAPPLLQELKKVIREPKPRSARWLSTSIPEAQWHSSLARTSSAEYNVNNLVSPVLFQEALWHVPEHAVVLEIAPHALLQAVLKRGLKPSCTIIPLMKKDHRDNLEFFLAGIGRLHLSGIDANPNALFPPVEFPAPRGTPLISPLIKWDHSLAWDVPAAEDFPNGSGSPSAAIYNIDTSSESPDHYLVDHTLDGRVLFPATGYLSIVWKTLARALGLGVEQLPVVFEDVVLHQATILPKTGTVSLEVRLLEASRAFEVSENGNLVVSGKVYQWDDPDPRLFDHPESPTPNPTEPLFLAQAEVYKELRLRGYDYGPHFQGILEASLEGDSGRLLWKDNWVSFMDTMLQMSILGSAKHGLYLPTRVTAIHIDPATHRQKLYTLQDKAQVADVVVSRWLRVTVAGGVHISGLHTESAPRRQQEQQVPILEKFCFTPHTEEGCLSERAALQEELQLCKGLVQALQTKVTQQGLKMVVPGLDGAQIPRDPSQQELPRLLSAACRLQLNGNLQLELAQVLAQERPKLPEDPLLSGLLDSPALKACLDTAVENMPSLKMKVVEVLAGHGHLYSRIPGLLSPHPLLQLSYTATDRHPQALEAAQAELQQHDVAQGQWDPADPAPSALGSADLLVCNCAVAALGDPASALSNMVAALREGGFLLLHTLLRGHPLGDIVAFLTSTEPQYGQGILSQDAWESLFSRVSLRLVGLKKSFYGSTLFLCRRPTPQDSPIFLPVDDTSFRWVESLKGILADEDSSRPVWLKAINCATSGVVGLVNCLRREPGGNRLRCVLLSNLSSTSHVPEVDPGSAELQKVLQGDLVMNVYRDGAWGAFRHFLLEEDKPEEPTAHAFVSTLTRGDLSSIRWVCSSLRHAQPTCPGAQLCTVYYASLNFRDIMLATGKLSPDAIPGKWTSQDSLLGMEFSGRDASGKRVMGLVPAKGLATSVLLSPDFLWDVPSNWTLEEAASVPVVYSTAYYALVVRGRVRPGETLLIHSGSGGVGQAAIAIALSLGCRVFTTVGSAEKRAYLQARFPQLDSTSFANSRDTSFEQHVLWHTGGKGVDLVLNSLAEEKLQASVRCLATHGRFLEIGKFDLSQNHPLGMAIFLKNVTFHGVLLDAFFNESSADWREVWALVQAGIRDGVVRPLKCTVFHGAQVEDAFRYMAQGKHIGKVVVQVLAEEPEAVLKGAKPKLMSAISKTFCPAHKSYIIAGGLGGFGLELAQWLIQRGVQKLVLTSRSGIRTGYQAKQVRRWRRQGVQVQVSTSNISSLEGARGLIAEAAQLGPVGGVFNLAVVLRDGLLENQTPEFFQDVCKPKYSGTLNLDRVTREACPELDYFVVFSSVSCGRGNAGQSNYGFANSAMERICEKRRHEGLPGLAVQWGAIGDVGILVETMSTNDTIVSGTLPQRMASCLEVLDLFLNQPHMVLSSFVLAEKAAAYRDRDSQRDLVEAVAHILGIRDLAAVNLDSSLADLGLDSLMSVEVRQTLERELNLVLSVREVRQLTLRKLQELSSKADEASELACPTPKEDGLAQQQTQLNLRSLLVNPEGPTLMRLNSVQSSERPLFLVHPIEGSTTVFHSLASRLSIPTYGLQCTRAAPLDSIHSLAAYYIDCIRQVQPEGPYRVAGYSYGACVAFEMCSQLQAQQSPAPTHNSLFLFDGSPTYVLAYTQSYRAKLTPGCEAEAETEAICFFVQQFTDMEHNRVLEALLPLKGLEERVAAAVDLIIKSHQGLDRQELSFAARSFYYKLRAAEQYTPKAKYHGNVMLLRAKTGGAYGEDLGADYNLSQVCDGKVSVHVIEGDHRTLLEGSGLESIISIIHSSLAEPRVSVREG

SEQ ID NO: 16510 - protein, 281 aa, Homo Sapiens
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 16511 - protein, 393 aa, Homo Sapiens [sequence omitted]

SEQ ID NO: 16512 - protein, 455 aa, Homo Sapiens; identical to SEQ ID NO: 13589

SEQ ID NO: 16513 - protein, 461 aa, Homo Sapiens; identical to SEQ ID NO: 13591

SEQ ID NO: 16514 - protein, 468 aa, Homo Sapiens
MAPPPARVHLGAFLAVTPNPGSAASGTEAAAATPSKVWGSSAGRIEPRGGGRGALPTSMGQHGPSARARAGRAPGPRPAREASPRLRVHKTFKFVVVGVLLQVVPSSAATIKLHDQSIGTQQWEHSPLGELCPPGSHRSEHPGACNRCTEGVGYTNASNNLFACLPCTACKSDEEERSPCTTTRNTACQCKPGTFRNDNSAEMCRKCSRGCPRGMVKVKDCTPWSDIECVHKESGNGHNIWVILVVTLVVPLLLVAVLIVCCCIGSGCGGDPKCMDRVCFWRLGLLRGPGAEDNAHNEILSNADSLSTFVSEQQMESQEPADLTGVTVQSPGEAQCLLGPAEAEGSQRRRLLVPANGADPTETLMLFFDKFANIVPFDSWDQLMRQLDLTKNEIDVVRAGTAGPGDALYAMLMKWVNKTGRNASIHTLLDALERMEERHAREKIQDLLVDSGKFIYLEDGTGSAVSLE

SEQ ID NO: 16515 - protein, 440 aa, Homo Sapiens
MEQRGQNAPAASGARKRHGPGPREARGARPGPRVPKTLVLVVAAVLLLVSAESALITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEVPAVEETVTSSPGTPASPCSLSGIIIGVTVAAVVLIVAVFVCKSLLWKKVLPYLKGICSGGGGDPERVDRSSQRPGAEDNVLNEIVSILQPTQVPEQEMEVQEPAEPTGVNMLSPGESEHLLEPAEAERSQRRRLLVPANEGDPTETLRQCFDDFADLVPFDSWEPLMRKLGLMDNEIKVAKAEAAGHRDTLYTMLIKWVNKTGRDASVHTLLDALETLGERLAKQKIEDHLLSSGKFMYLEGNADSAMS

SEQ ID NO: 16516 - protein, 208 aa, Homo Sapiens
MDPFLVLLHSVSSSLSSSELTELKFLCLGRVGKRKLERVQSGLDLFSMLLEQNDLEPGHTELLRELLASLRRHDLLRRVDDFEAGAAAGAAPGEEDLCAAFNVICDNVGKDWRRLARQLKVSDTKIDSIEDRYPRNLTERVRESLRIWKNTEKENATVAHLVGALRSCQMNLVADLVQEVQQARDLQNRSGAMSPMSWNSDASTSEAS

SEQ ID NO: 16517 - protein, 312 aa, Homo Sapiens
MAAGQNGHEEWVGSAYLFVESSLDKVVLSDAYAHPQQKVAVYRALQAALAESGGSPDVLQMLKIHRSDPQLIVQLRFCGRQPCGRFLRAYREGALRAALQRSLAAALAQHSVPLQLELRAGAERLDALLADEERCLSCILAQQPDRLRDEELAELEDALRNLKCGSGARGGDGEVASAPLQPPVPSLSEVKPPPPPPPAQTFLFQGQPVVNRPLSLKDQQTFARSVGLKWRKVGRSLQRGCRALRDPALDSLAYEYEREGLYEQAFQLLRRFVQAEGRRATLQRLVEALEENELTSLAEDLLGLTDPNGGLA

SEQ ID NO: 16518 - protein, 192 aa, Homo Sapiens
MDGSGEQPRGGGPTSSEQIMKTGALLLQGFIQDRAGRMGGEAPELALDPVPQDASTKKLSECLKRIGDELDSNMELQRMIAAVDTDSPREVFFRVAADMFSDGNFNWGRVVALFYFASKLVLKALCTKVPELIRTIMGWTLDFLRERLLGWIQDQGGWDGLLSYFGTPTWQTVTIFVAGVLTASLTIWKKMG

SEQ ID NO: 16519 - protein, 211 aa, Homo Sapiens
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 16520 - protein, 246 aa, Homo Sapiens
MTMDKSELVQKAKLAEQAERYDDMAAAMKAVTEQGHELSNEERNLLSVAYKNVVGARRSSWRVISSIEQKTERNEKKQQMGKEYREKIEAELQDICNDVLELLDKYLIPNATQPESKVFYLKMKGDYFRYLSEVASGDNKQTTVSNSQQAYQEAFEISKKEMQPTHPIRLGLALNFSVFYYEILNSPEKACSLAKTAFDEAIAELDTLNEESYKDSTLIMQLLRDNLTLWTSENQGDEGDAGEGEN

SEQ ID NO: 16521 - protein, 239 aa, Homo Sapiens
MAHAGRTGYDNREIVMKYIHYKLSQRGYEWDAGDVGAAPPGAAPAPGIFSSQPGHTPHPAASRDPVARTSPLQTPAAPGAAAGPALSPVPPVVHLTLRQAGDDFSRRYRRDFAEMSSQLHLTPFTARGRFATVVEELFRDGVNWGRIVAFFEFGGVMCVESVNREMSPLVDNIALWMTEYLNRHLHTWIQDNGGWDAFVELYGPSMRPLFDFSWLSLKTLLSLALVGACITLGAYLGHK

SEQ ID NO: 16522 - protein, 105 aa, Homo Sapiens
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 16523 - protein, 239 aa, Homo Sapiens
MAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 16524 - protein, 422 aa, Homo Sapiens
MALRGSHRLEVIFKRCIASPVLHSHAANRRSSQLAIKEGDPNSNGNSGQYQQNGEQKEKGWRRLVRFFVPFSLGAVVSAAIIQREDLTPTIAASKMTGRRRDFNFIADVVAGCADSVVYIEIKDTRHFDYFSGQPITASNGSGFIIEQNGLILTNAHVVINKPHTMVQVRLSDGRTFPATIEDVDQTSDLATLRIQVNNLSVMRLGKSSTLRSGEWVVALGSPLALSNTVTAGVISSTQRASQELGLRNRDINYLQTDAAITFGNSGGPLVNLDGEAIGVNSMKVTAGISFAIPIDYVKVFLERAAEKRKKGSAYKTGYPVKRYMGITMLTLTPDILFELKSRSQNMPSNLTHGVLVWKVIVGSPAHSGGLQPGDIVTHINKKEIKNSSDVYDALADNSKTLDIVILRGVKQMHVTITPEDP

SEQ ID NO: 16525 - protein, 613 aa, Homo Sapiens
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 16526 - protein, 368 aa, Homo Sapiens; identical to SEQ ID NO: 4940

SEQ ID NO: 16527 - protein, 416 aa, Homo Sapiens
MDEADRRLLRRCRLRLVEELQVDQLWDALLSRELFRPHMIEDIQRAGSGSRRDQARQLIIDLETRGSQALPLFISCLEDTGQDMLASFLRTNRQAAKLSKPTLENLTPVVLRPEIRKPEVLRPETPRPVDIGSGGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 16528 - protein, 452 aa, Homo Sapiens
MAAPSAGSWSTFQHKELMAADRGRRILGVCGMHPHHQETLKKNRVVLAKQLLLSELLEHLLEKDIITLEMRELIQAKVGSFSQNVELLNLLPKRGPQAFDAFCEALRETKQGHLEDMLLTTLSGLQHVLPPLSCDYDLSLPFPVCESCPLYKKLRLSTDTVEHSLDNKDGPVCLQVKPCTPEFYQTHFQLAYRLQSRPRGLALVLSNVHFTGEKELEFRSGGDVDHSTLVTLFKLLGYDVHVLCDQTAQEMQEKLQNFAQLPAHRVTDSCIVALLSHGVEGAIYGVDGKLLQLQEVFQLFDNANCPSLQNKPKMFFIQACRGDETDRGVDQQDGKNHAGSPGCEESDAGKEKLPKMRLPTRSDMICGYACLKGTAAMRNTKRGSWYIEALAQVFSERACDMHVADMLVKVNALIKDREGYAPGTEFHRCKEMSEYCSTLCRHLYLFPGHPPT

SEQ ID NO: 16529 - protein, 479 aa, Homo Sapiens
MDFSRNLYDIGEQLDSEDLASLKFLSLDYIPQRKQEPIKDALMLFQRLQEKRMLEESNLSFLKELLFRINRLDLLITYLNTRKEEMERELQTPGRAQISAYRVMLYQISEEVSRSELRSFKFLLQEEISKCKLDDDMNLLDIFIEMEKRVILGEGKLDILKRVCAQINKSLLKIINDYEEFSKERSSSLEGSPDEFSNGEELCGVMTISDSPREQDSESQTLDKVYQMKSKPRGYCLIINNHNFAKAREKVPKLHSIRDRNGTHLDAGALTTTFEELHFEIKPHDDCTVEQIYEILKIYQLMDHSNMDCFICCILSHGDKGIIYGTDGQEAPIYELTSQFTGLKCPSLAGKPKVFFIQACQGDNYQKGIPVETDSEEQPYLEMDLSSPQTRYIPDEADFLLGMATVNNCVSYRNPAEGTWYIQSLCQSLRERCPRGDDILTILTEVNYEVSNKDDKKNMGKQMPQPTFTLRKKLVFPSD

SEQ ID NO: 16530 - protein, 521 aa, Homo Sapiens
MKSQGQHWYSSSDKNCKVSFREKLLIIDSNLGVQDVENLKFLCIGLVPNKKLEKSSSASDVFEHLLAEDLLSEEDPFFLAELLYIIRQKKLLQHLNCTKEEVERLLPTRQRVSLFRNLLYELSEGIDSENLKDMIFLLKDSLPKTEMTSLSFLAFLEKQGKIDEDNLTCLEDLCKTVVPKLLRNIEKYKREKAIQIVTPPVDKEAESYQGEEELVSQTDVKTFLEALPQESWQNKHAGSNGNRATNGAPSLVSRGMQGASANTLNSETSTKRAAVYRMNRNHRGLCVIVNNHSFTSLKDRQGTHKDAEILSHVFQWLGFTVHIHNNVTKVEMEMVLQKQKCNPAHADGDCFVFCILTHGRFGAVYSSDEALIPIREIMSHFTALQCPRLAEKPKLFFIQACQGEEIQPSVSIEADALNPEQAPTSLQDSIPAEADFLLGLATVPGYVSFRHVEEGSWYIQSLCNHLKKLVPRMLKFLEKTMEIRGRKRTVWGAKQISATSLPTAISAQTPRPPMRRWSSVS

SEQ ID NO: 16531 - protein, 277 aa, Homo Sapiens
MENTENSVDSKSIKNLEPKIIHGSESMDSGISLDNSYKMDYPEMGLCIIINNKNFHKSTGMTSRSGTDVDAANLRETFRNLKYEVRNKNDLTREEIVELMRDVSKEDHSKRSSFVCVLLSHGEEGIIFGTNGPVDLKKITNFFRGDRCRSLTGKPKLFIIQACRGTELDCGIETDSGVDDDMACHKIPVEADFLYAYSTAPGYYSWRNSKDGSWFIQSLCAMLKQYADKLEFMHILTRVNRKVATEFESFSFDATFHAKKQIPCIVSMLTKELYFYH

SEQ ID NO: 16532 - protein, 293 aa, Homo Sapiens
MSSASGLRRGHPAGGEENMTETDAFYKREMFDPAEKYKMDHRRRGIALIFNHERFFWHLTLPERRGTCADRDNLTRRFSDLGFEVKCFNDLKAEELLLKIHEVSTVSHADADCFVCVFLSHGEGNHIYAYDAKIEIQTLTGLFKGDKCHSLVGKPKIFIIQACRGNQHDVPVIPLDVVDNQTEKLDTNITEVDAASVYTLPAGADFLMCYSVAEGYYSHRETVNGSWYIQDLCEMLGKYGSSLEFTELLTLVNRKVSQRRVDFCKDPSAIGKKQVPCFASMLTKKLHFFPKSN

SEQ ID NO: 16533 - protein, 303 aa, Homo Sapiens
MADDQGCIEEQGVEDSANEDSVDAKPDRSSFVPSLFSKKKKNVTMRSIKTTRDRVPTYQYNMNFEKLGKCIIINNKNFDKVTGMGVRNGTDKDAEALFKCFRSLGFDVIVYNDCSCAKMQDLLKKASEEDHTNAACFACILLSHGEENVIYGKDGVTPIKDLTAHFRGDRCKTLLEKPKLFFIQACRGTELDDGIQADSGPINDTDANPRYKIPVEADFLFAYSTVPGYYSWRSPGRGSWFVQALCSILEEHGKDLEIMQILTRVNDRVARHFESQSDDPHFHEKKQIPCVVSMLTKELYFSQ

SEQ ID NO: 16534 - protein, 233 aa, Homo Sapiens
MSTESMIRDVELAEEALPKKTGGPQGSRRCLFLSLFSFLIVAGATTLFCLLHFGVIGPQREEFPRDLSLISPLAQAVRSSSRTPSDKPVAHVVANPQAEGQLQWLNRRANALLANGVELRDNQLVVPSEGLYLIYSQVLFKGQGCPSTHVLLTHTISRIAVSYQTKVNLLSAIKSPCQRETPEGAEAKPWYEPIYLGGVFQLEKGDRLSAEINRPDYLDFAESGQVYFGIIAL

SEQ ID NO: 16535 - protein, 249 aa, Homo Sapiens; identical to SEQ ID NO: 13611

SEQ ID NO: 16536 - protein, 129 aa, Homo Sapiens; identical to SEQ ID NO: 13567

SEQ ID NO: 16537 - protein, 281 aa, Homo Sapiens [sequence omitted]

SEQ ID NO: 16538 - protein, 251 aa, Homo Sapiens; identical to SEQ ID NO: 13613

SEQ ID NO: 16539 - protein, 671 aa, Homo Sapiens
MQPDMSLNVIKMKSSDFLESAELDSGGFGKVSLCFHRTQGLMIMKTVYKGPNCIEHNEALLEEAKMMNRLRHSRVVKLLGVIIEEGKYSLVMEYMEKGNLMHVLKAEMSTPLSVKGRIILEIIEGMCYLHGKGVIHKDLKPENILVDNDFHIKIADLGLASFKMWSKLNNEEHNELREVDGTAKKNGGTLYYMAPEHLNDVNAKPTEKSDVYSFAVVLWAIFANKEPYENAICEQQLIMCIKSGNRPDVDDITEYCPREIISLMKLCWEANPEARPTFPGIEEKFRPFYLSQLEESVEEDVKSLKKEYSNENAVVKRMQSLQLDCVAVPSSRSNSATEQPGSLHSSQGLGMGPVEESWFAPSLEHPQEENEPSLQSKLQDEANYHLYGSRMDRQTKQQPRQNVAYNREEERRRRVSHDPFAQQRPYENFQNTEGKGTAYSSAASHGNAVHQPSGLTSQPQVLYQNNGLYSSHGFGTRPLDPGTAGPRVWYRPIPSHMPSLHNIPVPETNYLGNTPTMPFSSLPPTDESIKYTIYNSTGIQIGAYNYMEIGGTSSSLLDSTNTNFKEEPAAKYQAIFDNTTSLTDKHLDPIRENLGKHWKNCARKLGFTQSQIDEIDHDYERDGLKEKVYQMLQKWVMREGIKGATVGKLAQALHQCSRIDLLSSLIYVSQN

SEQ ID NO: 16540 - protein, 616 aa, Homo Sapiens
MEILQNSPFLRGLCRTSAPADLQYDNTSELFRISTFAKFPSTAPVTERSLARAGFFYTGICDRVQCFRCNVTIDNWQTGECPAERHKQMSPNCAFIQSLPSTANLLSSSHSAFSPLRNATILQLNLPAVTSASGQTDEQVGYLNMSNLAPSSPLSSRGVEDMSHQRPSACHNPSMRREQDRLDTFQNWTLTTITPAELAKAGFYYLSQGDRVACFSCGGHLSNWEPGDRAMSEHQRHYPNCRFVRGDRADNISIAGGLANVSNPAMQQCEERLLTFVNWPARIPVRPDQLAKAGFYYVGRNDDVKCFCCDGGLRCWESGDDPWVEHAKWFPRCEYLLQEKGQEFVHQIQARFPRLFEQLLNNGDSREFVDPPVVHLGPGEERSEDAVMMNTPVVKAALEMGFDRNLVKQTVQSKILTSGENYKTVQELVSDLLSAEDEKREEEREMFAEEMASDGFTFLKKHHAALTQRLKSVQSLMDHLLEENVISQKEYDTIRNCTSVKQQTGQLIDLVLSKGNAAAEVFRNWIKKNDVYLLRELMAQTNEAVSPSQDLSDLPMEEQLRRLQEERTCKVCMDKEVNIVFIPCGHLVVCKECAPSLRKCPICRGMVKGTVRTFLS

SEQ ID NO: 16541 - protein, 501 aa, Homo Sapiens
MAAASVTPPGSLELLQPGFSKTLLGTKLEAKYLCSACRNVLRRPFQAQCGHRYCSFCLASILSSGPQNCAACVHEGIYEEGISILESSSAFPDNAARREVESLPAVCPSDGCTWKGTLKEYESCHEGRCPLMLTECPACKGLVRLGEKERHLEHECPERSLSCRHCRAPCCGADVKAHHEVCPKFPLTCDGCGKKKIPREKFQDHVKTCGKCRVPCRFHAIGCLETVEGEKQQEHEVQWLREHLAMLLSSVLEAKPLLGDQSHAGSELLQRCESLEKKTATFENIVCVLNREVERVAMTAEACSRQHRLDQDKIEALSSKVQQLERSIGLKDLAMADLEQKVLEMEASTYDGVFIWKISDFARKRQEAVAGRIPAIFSPAFYTSRYGYKMCLRIYLNGDGTGRGTHLSLFFVVMKGPNDALLRWPFNQKVTLMLLDQNNREHVIDAFRPDVTSSSFQRPVNDMNIASGCPLFCPVSKMEAKNSYVRDDAIFIKAIVDLTGL

SEQ ID NO: 16542 - protein, 826 aa, Homo Sapiens; identical to SEQ ID NO: 15084

SEQ ID NO: 16543 - protein, 213 aa, Homo Sapiens
MPRRAENWDEAEVGAEEAGVEEYGPEEDGGEESGAEESGPEESGPEELGAEEEMEAGRPRPVLRSVNSREPSQVIFCNRSPRVVLPVWLNFDGEPQPYPTLPPGTGRRIHSYRGHLWLFRDAGTHDGLLVNQTELFVPSLNVDGQPIFANITLPVYTLKERCLQVVRSLVKPENYRRLDIVRSLYEDLEDHPNVQKDLERLTQERIAHQRMGD

SEQ ID NO: 16544 - protein, 492 aa, Homo Sapiens
MEPSSKKLTGRLMLAVGGAVLGSLQFGYNTGVINAPQKVIEEFYNQTWVHRYGESILPTTLTTLWSLSVAIFSVGGMIGSFSVGLFVNRFGRRNSMLMMNLLAFVSAVLMGFSKLGKSFEMLILGRFIIGVYCGLTTGFVPMYVGEVSPTALRGALGTLHQLGIVVGILIAQVFGLDSIMGNKDLWPLLLSIIFIPALLQCIVLPFCPESPRFLLINRNEENRAKSVLKKLRGTADVTHDLQEMKEESRQMMREKKVTILELFRSPAYRQPILIAVVLQLSQQLSGINAVFYYSTSIFEKAGVQQPVYATIGSGIVNTAFTVVSLFVVERAGRRTLHLIGLAGMAGCAILMTIALALLEQLPWMSYLSIVAIFGFVAFFEVGPGPIPWFIVAELFSQGPRPAAIAVAGFSNWTSNFIVGMCFQYVEQLCGPYVFIIFTVLLVLFFIFTYFKVPETKGRTFDEIASGFRQGGASQSDKTPEELFHPLGADSQV

SEQ ID NO: 16545 - protein, 262 aa, Homo Sapiens; identical to SEQ ID NO: 7713

SEQ ID NO: 16546 - protein, 630 aa, Homo Sapiens
MELQPPEASIAVVSIPRQLPGSHSEAGVQGLSAGDDSELGSHCVAQTGLELLASGDPLPSASQNAEMIETGSDCVTQAGLQLLASSDPPALASKNAEVTGTMSQDTEVDMKEVELNELEPEKQPMNAASGAAMSLAGAEKNGLVKIKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKGQSEDPGSLLSLFRRLSDQRSKERSLLHGDFHAFSAGPGLFSYIRHWDQNERFLVVLNFGDVGLSAGLQASDLPASASLPAKADLLLSTQPGREEGSPLELERLKLEPHEGLLLRFPYAA

SEQ ID NO: 16547 - protein, 541 aa, Homo Sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 16548 - protein, 629 aa, Homo Sapiens
MGCKVLLNIGQQMLRRKVVDCSREETRLSRCLNTFDLVALGVGSTLGAGVYVLAGAVARENAGPAIVISFLIAALASVLAGLCYGEFGARVPKTGSAYLYSYVTVGELWAFITGWNLILSYIIGTSSVARAWSATFDELIGRPIGEFSRTHMTLNAPGVLAENPDIFAVIIILILTGLLTLGVKESAMVNKIFTCINVLVLGFIMVSGFVKGSVKNWQLTEEDFGNTSGRLCLNNDTKEGKPGVGGFMPFGFSGVLSGAATCFYAFVGFDCIATTGEEVKNPQKAIPVGIVASLLICFIAYFGVSAALTLMMPYFCLDNNSPLPDAFKHVGWEGAKYAVAVGSLCALSASLLGSMFPMPRVIYAMAEDGLLFKFLANVNDRTKTPIIATLASGAVAAVMAFLFDLKDLVDLMSIGTLLAYSLVAACVLVLRYQPEQPNLVYQMASTSDELDPADQNELASTNDSQLGFLPEAEMFSLKTILSPKNMEPSKISGLIVNISTSLIAVLIITFCIVTVLGREALTKGALWAVFLLAGSALLCAVVTGVIWRQPESKTKLSFKVPFLPVLPILSIFVNVYLMMQLDQGTWVRFAVWMLIGFIIYFGYGLWHSEEASLDADQARTPDGNLDQCK

SEQ ID NO: 16549 - protein, 658 aa, Homo Sapiens
MIPCRAALTFARCLIRRKIVTLDSLEDTKLCRCLSTMDLIALGVGSTLGAGVYVLAGEVAKADSGPSIVVSFLIAALASVMAGLCYAEFGARVPKTGSAYLYTYVTVGELWAFITGWNLILSYVIGTSSVARAWSGTFDELLSKQIGQFLRTYFRMNYTGLAEYPDFFAVCLILLLAGLLSFGVKESAWVNKVFTAVNILVLLFVMVAGFVKGNVANWKISEEFLKNISASAREPPSENGTSIYGAGGFMPYGFTGTLAGAATCFYAFVGFDCIATTGEEVRNPQKAIPIGIVTSLLVCFMAYFGVSAALTLMMPYYLLDEKSPLPVAFEYVGWGPAKYVVAAGSLCALSTSLLGSIFPMPRVIYAMAEDGLLFKCLAQINSKTKTPIIATLSSGAVAALMAFLFDLKALVDMMSIGTLMAYSLVAACVLILRYQPGLSYDQPKCSPEKDGLGSSPRVTSKSESQVTMLQRQGFSMRTLFCPSLLPTQQSASLVSFLVGFLAFLVLGLSVLTTYGVHAITRLEAWSLALLALFLVLFVAIVLTIWRQPQNQQKVAFMVPFLPFLPAFSILVNIYLMVQLSADTWVRFSIWMAIGFLIYFSYGIRHSLEGHLRDENNEEDAYPDNVHAAAEEKSAIQANDHHPRNLSSPFIFHEKTSEF

SEQ ID NO: 16550 - protein, 619 aa, Homo Sapiens
MPWQAFRRFGQKLVRRRTLESGMAETRLARCLSTLDLVALGVGSTLGAGVYVLAGEVAKDKAGPSIVICFLVAALSSVLAGLCYAEFGARVPRSGSAYLYSYVTVGELWAFTTGWNLILSYVIGTASVARAWSSAFDNLIGNHISKTLQGSIALHVPHVLAEYPDFFALGLVLLLTGLLALGASESALVTKVFTGVNLLVLGFVMISGFVKGDVHNWKLTEEDYELAMAELNDTYSLGPLGSGGFVPFGFEGILRGAATCFYAFVGFDCIATTGEEAQNPQRSIPMGIVISLSVCFLAYFAVSSALTLMMPYYQLQPESPLPEAFLYIGWAPARYVVAVGSLCALSTSLLGSMFPMPRVIYAMAEDGLLFRVLARIHTGTRTPIIATVVSGIIAAFMAFLFKLTDLVDLMSIGTLLAYSLVSICVLILRYQPDQETKTGEEVELQEEAITTESEKLTLWGLFFPLNSIPTPLSGQIVYVCSSLLAVLLTALCLVLAQWSVPLLSGDLLWTAVVVLLLLLIIGIIVVIWRQPQSSTPLHFKVPALPLLPLMSIFVNIYLMMQMTAGTWARFGVWMLIGFAIYFGYGIQHSLEEIKSNQPSRKSRAKTVDLDPGTLYVHSV

SEQ ID NO: 16551 - protein, 635 aa, Homo Sapiens
MARGLPTIASLARLCQKLNRLKPLEDSTMETSLRRCLSTLDLTLLGVGGMVGSGLYVLTGAVAKEVAGPAVLLSFGVAAVASLLAALCYAEFGARVPRTGSAYLFTYVSMGELWAFLIGWNVLLEYIIGGAAVARAWSGYLDSMFSHSIRNFTETHVGSWQVPLLGHYPDFLAAGIILLASAFVSCGARVSSWLNHTFSAISLLVILFIVILGFILAQPHNWSADEGGFAPFGFSGVMAGTASCFYAFVGFDVIAASSEEAQNPRRSVPLAIAISLAIAAGAYILVSTVLTLMVPWHSLDPDSALADAFYQRGYRWAGFIVAAGSICAMNTVLLSLLFSLPRIVYAMAADGLFFQVFAHVHPRTQVPVAGTLAFGLLTAFLALLLDLESLVQFLSLGTLLAYTFVATSIIVLRFQKSSPPSSPGPASPGPLTKQQSSFSDHLQLVGTVHASVPEPGELKPALRPYLGFLDGYSPGAVVTWALGVMLASAITIGCVLVFGNSTLHLPHWGYILLLLLTSVMFLLSLLVLGAHQQQYREDLFQIPMVPLIPALSIVLNICLMLKLSYLTWVRFSIWLLMGLAVYFGYGIRHSKENQRELPGLNSTHYVVFPRGSLEETVQAMQPPSQAPAQDPGHME

SEQ ID NO: 16552 - protein, 507 aa, Homo Sapiens
MAGAGPKRRALAAPAAEEKEEAREKMLAAKSADGSAPAGEGEGVTLQRNITLLNGVAIIVGTIIGSGIFVTPTGVLKEAGSPGLALVVWAACGVFSIVGALCYAELGTTISKSGGDYAYMLEVYGSLPAFLKLWIELLIIRPSSQYIVALVFATYLLKPLFPTCPVPEEAAKLVACLCVLLLTAVNCYSVKAATRVQDAFAAAKLLALALIILLGFVQIGKGDVSNLDPNFSFEGTKLDVGNIVLALYSGLFAYGGWNYLNFVTEEMINPYRNLPLAIIISLPIVTLVYVLTNLAYFTTLSTEQMLSSEAVAVDFGNYHLGVMSWIIPVFVGLSCFGSVNGSLFTSSRLFFVGSREGHLPSILSMIHPQLLTPVPSLVFTCVMTLLYAFSKDIFSVINFFSFFNWLCVALAIIGMIWLRHRKPELERPIKVNLALPVFFILACLFLIAVSFWKTPVECGIGFTIILSGLPVYFFGVWWKNKPKWLLQGIFSTTVLCQKLMQVVPQET

SEQ ID NO: 16553 - protein, 515 aa, Homo Sapiens
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQGHSEHFQDAFEGSSWDMGNLSLALYSALFSYSGWDTLNFVTEEIKNPERNLPLAIGISMPIVTLIYILTNVAYYTVLNISDVLSSDAVAVTFADQTFGMFSWTIPIAVALSCFGGLNASIFASSRLFFVGSREGHLPDLLSMIHIERFTPIPALLFNCTMALIYLIVEDVFQLINYFSFSYWFFVGLSVVGQLYLRWKEPKRPRPLKLSVFFPIVFCICSVFLVIVPLFTDTINSLIGIGIALSGVPFYFMGVYLPESRRPLFIRNVLAAITRGTQQLCFCVLTELDVAEEKKDERKTD

SEQ ID NO: 16554 - protein, 511 aa, Homo Sapiens
MVDSTEYEVASQPEVETSPLGDGASPGPEQVKLKKEISLLNGVCLIVGNMIGSGIFVSPKGVLIYSASFGLSLVIWAVGGLFSVFGALCYAELGTTIKKSGASYAYILEAFGGFLAFIRLWTSLLIIEPTSQAIIAITFANYMVQPLFPSCFAPYAASRLLAAACICLLTFINCAYVKWGTLVQDIFTYAKVLALIAVIVAGIVRLGQGASTHFENSFEGSSFAVGDIALALYSALFSYSGWDTLNYVTEEIKNPERNLPLSIGISMPIVTIIYILTNVAYYTVLDMRDILASDAVAVTFADQIFGIFNWIIPLSVALSCFGGLNASIVAASRLFFVGSREGHLPDAICMIHVERFTPVPSLLFNGIMALIYLCVEDIFQLINYYSFSYWFFVGLSIVGQLYLRWKEPDRPRPLKLSVFFPIVFCLCTIFLVAVPLYSDTINSLIGIAIALSGLPFYFLIIRVPEHKRPLYLRRIVGSATRYLQVLCMSVAAEMDLEDGGEMPKQRDPKSN

SEQ ID NO: 16555 - protein, 535 aa, Homo Sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVTEELVDPYKNLPRAIFISIPLVTFVYVFANVAYVTAMSPQELLASNAVAVTFGEKLLGVMAWIMPISVALSTFGGVNGSLFTSSRLFFAGAREGHLPSVLAMIHVKRCTPIPALLFTCISTLLMLVTSDMYTLINYVGFINYLFYGVTVAGQIVLRWKKPDIPRPIKINLLFPIIYLLFWAFLLVFSLWSEPVVCGIGLAIMLTGVPVYFLGVYWQHKPKCFSDFIELLTLVSQKMCVVVYPEVERGSGTEEANEDMEEQQQPMYQPTPTKDKDVAGQPQP

SEQ ID NO: 16556 - protein, 487 aa, Homo Sapiens
MGDTGLRKRREDEKSIQSQEPKTTSLQKELGLISGISIIVGTIIGSGIFVSPKSVLSNTEAVGPCLIIWAACGVLATLGALCFAELGTMITKSGGEYPYLMEAYGPIPAYLFSWASLIVIKPTSFAIICLSFSEYVCAPFYVGCKPPQIVVKCLAAAAILFISTVNSLSVRLGSYVQNIFTAAKLVIVAIIIISGLVLLAQGNTKNFDNSFEGAQLSVGAISLAFYNGLWAYDGWNQLNYITEELRNPYRNLPLAIIIGIPLVTACYILMNVSYFTVMTATELLQSQAVAVTFGDRVLYPASWIVPLFVAFSTIGAANGTCFTAGRLIYVAGREGHMLKVLSYISVRRLTPAPAIIFYGIIATIYIIPGDINSLVNYFSFAAWLFYGLTILGLIVMRFTRKELERPIKVPVVIPVLMTLISVFLVLAPIISKPTWEYLYCVLFILSGLLFYFLFVHYKFGWAQKISKPITMHLQMLMEVVPPEEDPE

SEQ ID NO: 16557 - protein, 523 aa, Homo Sapiens
MAGHTQQPSGRGNPRPAPSPSPVPGTVPGASERVALKKEIGLLSACTIIIGNIIGSGIFISPKGVLEHSGSVGLALFVWVLGGGVTALGSLCYAELGVAIPKSGGDYAYVTEIFGGLAGFLLLWSAVLIMYPTSLAVISMTFSNYVLQPVFPNCIPPTTASRVLSMACLMLLTWVNSSSVRWATRIQDMFTGGKLLALSLIIGVGLLQIFQGHFEELRPSNAFAFWMTPSVGHLALAFLQGSFAFSGWNFLNYVTEEMVDARKNLPRAIFISIPLVTFVYTFTNIAYFTAMSPQELLSSNAVAVTFGEKLLGYFSWVMPVSVALSTFGGINGYLFTYSRLCFSGAREGHLPSLLAMIHVRHCTPIPALLVCCGATAVIMLVGDTYTLINYVSFINYLCYGVTILGLLLLRWRRPALHRPIKVNLLIPVAYLVFWAFLLVFSFISEPMVCGVGVIIILTGVPIFFLGVFWRSKPKCVHRLTESMTHWGQELCFVVYPQDAPEEEENGPCPPSLLPATDKPSKPQ

SEQ ID NO: 16558 - protein, 501 aa, Homo Sapiens
MVRKPVVSTISKGGYLQGNVNGRLPSLGNKEPPGQEKVQLKRKVTLLRGVSIIIGTIIGAGIFISPKGVLQNTGSVGMSLTIWTVCGVLSLFGALSYAELGTTIKKSGGHYTYILEVFGPLPAFVRVWVELLIIRPAATAVISLAFGRYILEPFFIQCEIPELAIKLITAVGITVVMVLNSMSVSWSARIQIFLTFCKLTAILIIIVPGVMQLIKGQTQNFKDAFSGRDSSITRLPLAFYYGMYAYAGWFYLNFVTEEVENPEKTIPLAICISMAIVTIGYVLTNVAYFTTINAEELLLSNAVAVTFSERLLGNFSLAVPIFVALSCFGSMNGGVFAVSRLFYVASREGHLPEILSMIHVRKHTPLPAVIVLHPLTMIMLFSGDLDSLLNFLSFARWLFIGLAVAGLIYLRYKCPDMHRPFKVPLFIPALFSFTCLFMVALSLYSDPFSTGIGFVITLTGVPAYYLFIIWDKKPRWFRIMSEKITRTLQIILEVVPEEDKL

SEQ ID NO: 16559 - protein, 470 aa, Homo Sapiens
MDRGEKIQLKRVFGYWWGTSFLLINIIGAGIFVSPKGVLAYSCMNVGVSLCVWAGCAILAMTSTLCSAEISISFPCSGAQYYFLKRYFGSTVAFLNLWTSLFLGSGVVAGQALLLAEYSIQPFFPSCSVPKLPKKCLALAMLWIVGILTSRGVKEVTWLQIASSVLKVSILSFISLTGVVFLIRGKKENVERFQNAFDAELPDISHLIQAIFQGYFAYSGGACFTLIAGELKKPRTTIPKCIFTALPLVTVVYLLVNISYLTVLTPREILSSDAVAITWADRAFPSLAWIMPFAISTSLFSNLLISIFKSSRPIYLASQEGQLPLLFNTLNSHSSPFTAVLLLVTLGSLAIILTSLIDLINYIFFTGSLWSILLMIGILRRRYQEPNLSIPYKVFLSFPLATIVIDVGLVVIPLVKSPNVHYVYVLLLVLSGLLFYIPLIHFKIRLAWFEKMTCYLQLLFNICLPDVSEE

SEQ ID NO: 16560 - protein, 771 aa, Homo Sapiens
MSGFFTSLDPRRVQWGAAWYAMHSRILRTKPVESMLEGTGTTTAHGTKLAQVLTTVDLISLGVGSCVGTGMYVVSGLVAKEMAGPGVIVSFIIAAVASILSGVCYAEFGVRVPKTTGSAYTYSYVTVGEFVAFFIGWNLILEYLIGTAAGASALSSMFDSLANHTISRWMADSVGTLNGLGKGEESYPDLLALLIAVIVTIIVALGVKNSIGFNNVLNVLNLAVWVFIMIAGLFFINGKYWAEGQFLPHGWSGVLQGAATCFYAFIGFDIIATTGEEAKNPNTSIPYAITASLVICLTAYVSVSVILTLMVPYYTIDTESPLMEMFVAHGFYAAKFVVAIGSVAGLTVSLLGSLFPMPRVIYAMAGDGLLFRFLAHVSSYTETPVVACIVSGFLAALLALLVSLRDLIEMMSIGTLLAYTLVSVCVLLLRYQPESDIDGFVKFLSEEHTKKKEGILADCEKEACSPVSEGDEFSGPATNTCGAKNLPSLGDNEMLIGKSDKSTYNVNHPNYGTVDMTTGIEADESENIYLIKLKKLIGPHYYTMRIRLGLPGKMDRPTAATGHTVTICVLLLFILMFIFCSFIIFGSDYISEQSWWAILLVVLMVLLISTLVFVILQQPENPKKLPYMAPCLPFVPAFAMLVNIYLMLKLSTITWIRFAVWCFVGLLIYFGYGIWNSTLEISAREEALHQSTYQRYDVDDPFSVEEGFSYATEGESQEDWGGPTEDKGFYYQQMSDAKANGRTSSKAKSKSKHKQNSEALIANDELDYSPE

SEQ ID NO: 16561 - protein, 630 aa, Homo Sapiens; identical to SEQ ID NO: 16546

SEQ ID NO: 16562 - protein, 658 aa, Homo Sapiens; identical to SEQ ID NO: 16549

SEQ ID NO: 16563 - protein, 619 aa, Homo Sapiens; identical to SEQ ID NO: 16550

SEQ ID NO: 16564 - protein, 635 aa, Homo Sapiens; identical to SEQ ID NO: 16551

SEQ ID NO: 16565 - protein, 1483 aa, Homo Sapiens
MAPLLGRKPFPLVKPLPGEEPLFTIPHTQEAFRTREEYEARLERYSERIWTCKSTGSSQLTHKEAWEEEQEVAELLKEEFPAWYEKLVLEMVHHNTASLEKLVDTAWLEIMTKYAVGEECDFEVGKEKMLKVKIVKIHPLEKVDEEATEKKSDGACDSPSSDKENSSQIAQDHQKKETVVKEDEGRRESINDRARRSPRKLPTSLKKGERKWAPPKFLPHKYDVKLQNEDKIISNVPADSLIRTERPPNKEIVRYFIRHNALRAGTGENAPWVVEDELVKKYSLPSKFSDFLLDPYKYMTLNPSTKRKNTGSPDRKPSKKSKTDNSSLSSPLNPKLWCHVHLKKSLSGSPLKVKNSKNSKSPEEHLEEMMKMMSPNKLHTNFHIPKKGPPAKKPGKHSDKPLKAKGRSKGILNGQKSTGNSKSPKKGLKTPKTKMKQMTLLDMAKGTQKMTRAPRNSGGTPRTSSKPHKHLPPAALHLIAYYKENKDREDKRSALSCVISKTARLLSSEDRARLPEELRSLVQKRYELLEHKKRWASMSEEQRKEYLKKKREELKKKLKEKAKERREKEMLERLEKQKRYEDQELTGKNLPAFRLVDTPEGLPNTLFGDVAMVVEFLSCYSGLLLPDAQYPITAVSLMEALSADKGGFLYLNRVLVILLQTLLQDEIAEDYGELGMKLSEIPLTLHSVSELVRLCLRRSDVQEESEGSDTDDNKDSAAFEDNEVQDEFLEKLETSEFFELTSEEKLQILTALCHRILMTYSVQDHMETRQQMSAELWKERLAVLKEENDKKRAEKQKRKEMEAKNKENGKVENGLGKTDRKKEIVKFEPQVDTEAEDMISAVKSRRLLAIQAKKEREIQEREMKVKLERQAEEERIRKHKAAAEKAFQEGIAKAKLVMRRTPIGTDRNHNRYWLFSDEVPGLFIEKGWVHDSIDYRFNHHCKDHTVSGDEDYCPRSKKANLGKNASMNTQHGTATEVAVETTTPKQGQNLWFLCDSQKELDELLNCLHPQGIRESQLKERLEKRYQDIIHSIHLARKPNLGLKSCDGNQELLNFLRSDLIEVATRLQKGGLGYVEETSEFEARVISLEKLKDFGECVIALQASVIKKFLQGFMAPKQKRRKLQSEDSAKTEEVDEEKKMVEEAKVASALEKWKTAIREAQTFSRMHVLLGMLDACIKWDMSAENARCKVCRKKGEDDKLILCDECNKAFHLFCLRPALYEVPDGEWQCPACQPATARRNSRGRNYTEESASEDSEDDESDEEEEEEEEEEEEEDYEVAGLRLRPRKTIRGKHSVIPPAARSGRRPGKKPHSTRRSQPKAPPVDDAEVDELVLQTKRSSRRQSLELQKCEEILHKIVKYRFSWPFREPVTRDEAEDYYDVITHPMDFQTVQNKCSCGSYRSVQEFLTDMKQVFTNAEVYNCRGSHVLSCMVKTEQCLVALLHKHLPGHPYVRRKRKKFPDRLAEDEGDSEPEAVGQSRGRRQKK

SEQ ID NO: 16566 - protein, 530 aa, Homo Sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 16567 - protein, 228 aa, Homo Sapiens
MSVSEIFVELQGFLAAEQDIREEIRKVVQSLEQTAREILTLLQGVHQGAGFQDIPKRCLKAREHFGTVKTHLTSLKTKFPAEQYYRFHEHWRFVLQRLVFLAAFVVYLETETLVTREAVTEILGIEPDREKGFHLDVEDYLSGVLILASELSRLSVNSVTAGDYSRPLHISTFINELDSGFRLLNLKNDSLRKRYDGLKYDVKKVEEVVYDLSIRGFNKETAAACVEK

SEQ ID NO: 16568 - protein, 140 aa, Homo Sapiens; identical to SEQ ID NO: 14672

SEQ ID NO: 16569 - protein, 176 aa, Homo Sapiens; identical to SEQ ID NO: 14673

SEQ ID NO: 16570 - protein, 164 aa, Homo Sapiens; identical to SEQ ID NO: 14674

SEQ ID NO: 16571 - protein, 207 aa, Homo Sapiens; identical to SEQ ID NO: 14675

SEQ ID NO: 16572 - protein, 182 aa, Homo Sapiens; identical to SEQ ID NO: 14676

SEQ ID NO: 16573 - protein, 171 aa, Homo Sapiens; identical to SEQ ID NO: 2330

SEQ ID NO: 16574 - protein, 552 aa, Homo Sapiens
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 16575 - protein, 270 aa, Homo Sapiens
MGNTSSERAALERHGGHKTPRRDSSGGTKDGDRPKILMDSPEDADLFHSEEIKAPEKEEFLAWQHDLEVNDKAPAQARPTVFRWTGGGKEVYLSGSFNNWSKLPLTRSHNNFVAILDLPEGEHQYKFFVDGQWTHDPSEPIVTSQLGTVNNIIQVKKTDFEVFDALMVDSQKCSDVSELSSSPPGPYHQEPYVCKPEERFRAPPILPPHLLQVILNKDTGISCDPALLPEPNHVMLNHLYALSIKDGVMVLSATHRYKKKYVTTLLYKPI

SEQ ID NO: 16576 - protein, 595 aa, Homo Sapiens
MPACCSCSDVFQYETNKVTRIQSMNYGTIKWFFHVIIFSYVCFALVSDKLYQRKEPVISSVHTKVKGIAEVKEEIVENGVKKLVHSVFDTADYTFPLQGNSFFVMTNFLKTEGQEQRLCPEYPTRRTLCSSDRGCKKGWMDPQSKGIQTGRCVVYEGNQKTCEVSAWCPIEAVEEAPRPALLNSAENFTVLIKNNIDFPGHNYTTRNILPGLNITCTFHKTQNPQCPIFRLGDIFRETGDNFSDVAIQGGIMGIEIYWDCNLDRWFHHCRPKYSFRRLDDKTTNVSLYPGYNFRYAKYYKENNVEKRTLIKVFGIRFDILVFGTGGKFDIIQLVVYIGSTLSYFGLAAVFIDFLIDTYSSNCCRSHIYPWCKCCQPCVVNEYYYRKKCESIVEPKPTLKYVSFVDESHIRMVNQQLLGRSLQDVKGQEVPRPAMDFTDLSRLPLALHDTPPIPGQPEEIQLLRKEATPRSRDSPVWCQCGSCLPSQLPESHRCLEELCCRKKPGACITTSELFRKLVLSRHVLQFLLLYQEPLLALDVDSTNSRLRHCAYRCYATWRFGSQDMADFAILPSCCRWRIRKEFPKSEGQYSGFKSPY

SEQ ID NO: 16577 - protein, 1465 aa, Homo Sapiens
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 16578 - protein, 1271 aa, Homo Sapiens
MVDPVGFAEAWKAQFPDSEPPRMELRSVGDIEQELERCKASIRRLEQEVNQERFRMIYLQTLLAKEKKSYDRQRWGFRRAAQAPDGASEPRASASRPQPAPADGADPPPAEEPEARPDGEGSPGKARPGTARRPGAAASGERDDRGPPASVAALRSNFERIRKGHGQPGADAEKPFYVNVEFHHERGLVKVNDKEVSDRISSLGSQAMQMERKKSQHGAGSSVGDASRPPYRGRSSESSCGVDGDYEDAELNPRFLKDNLIDANGGSRPPWPPLEYQPYQSIYVGGMMEGEGKGPLLRSQSTSEQEKRLTWPRRSYSPRSFEDCGGGYTPDCSSNENLTSSEEDFSSGQSSRVSPSPTTYRMFRDKSRSPSQNSQQSFDSSSPPTPQCHKRHRHCPVVVSEATIVGVRKTGQIWPNDGEGAFHGDADGSFGTPPGYGCAADRAEEQRRHQDGLPYIDDSPSSSPHLSSKGRGSRDALVSGALESTKASELDLEKGLEMRKWVLSGILASEETYLSHLEALLLPMKPLKAAATTSQPVLTSQQIETIFFKVPELYEIHKEFYDGLFPRVQQWSHQQRVGDLFQKLASQLGVYRAFVDNYGVAMEMAEKCCQANAQFAEISENLRARSNKDAKDPTTKNSLETLLYKPVDRVTRSTLVLHDLLKHTPASHPDHPLLQDALRISQNFLSSINEEITPRRQSMTVKKGEHRQLLKDSFMVELVEGARKLRHVFLFTDLLLCTKLKKQSGGKTQQYDCKWYIPLTDLSFQMVDELEAVPNIPLVPDEELDALKIKISQIKNDIQREKRANKGSKATERLKKKLSEQESLLLLMSPSMAFRVHSRNGKSYTFLISSDYERAEWRENIREQQKKCFRSFSLTSVELQMLTNSCVKLQTVHSIPLTINKEDDESPGLYGFLNVIVHSATGFKQSSNLYCTLEVDSFGYFVNKAKTRVYRDTAEPNWNEEFEIELEGSQTLRILCYEKCYNKTKIPKEDGESTDRLMGKGQVQLDPQALQDRDWQRTVIAMNGIEVKLSVKFNSREFSLKRMPSRKQTGVFGVKIAVVTKRERSKVPYIVRQCVEEIERRGMEEVGIYRVSGVATDIQALKAAFDVNNKDVSVMMSEMDVNAIAGTLKLYFRELPEPLFTDEFYPNFAEGIALSDPVAKESCMLNLLLSLPEANLLTFLFLLDHLKRVAEKEAVNKMSLHNLATVFGPTLLRPSEKESKLPANPSQPITMTDSWSLEVMSQVQVLLYFLQLEAIPAPDSKRQSILFSTEV

SEQ ID NO: 16579 - protein, 1130 aa, Homo Sapiens
MLEICLKLVGCKSKKGLSSSSSCYLEEALQRPVASDFEPQGLSEAARWNSKENLLAGPSENDPNLFVALYDFVASGDNTLSITKGEKLRVLGYNHNGEWCEAQTKNGQGWVPSNYITPVNSLEKHSWYHGPVSRNAAEYLLSSGINGSFLVRESESSPGQRSISLRYEGRVYHYRINTASDGKLYVSSESRFNTLAELVHHHSTVADGLITTLHYPAPKRNKPTVYGVSPNYDKWEMERTDITMKHKLGGGQYGEVYEGVWKKYSLTVAVKTLKEDTMEVEEFLKEAAVMKEIKHPNLVQLLGVCTREPPFYIITEFMTYGNLLDYLRECNRQEVNAVVLLYMATQISSAMEYLEKKNFIHRDLAARNCLVGENHLVKVADFGLSRLMTGDTYTAHAGAKFPIKWTAPESLAYNKFSIKSDVWAFGVLLWEIATYGMSPYPGIDLSQVYELLEKDYRMERPEGCPEKVYELMRACWQWNPSDRPSFAEIHQAFETMFQESSISDEVEKELGKQGVRGAVSTLLQAPELPTKTRTSRRAAEHRDTTDVPEMPHSKGQGESDPLDHEPAVSPLLPRKERGPPEGGLNEDERLLPKDKKTNLFSALIKKKKKTAPTPPKRSSSFREMDGQPERRGAGEEEGRDISNGALAFTPLDTADPAKSPKPSNGAGVPNGALRESGGSGFRSPHLWKKSSTLTSSRLATGEEEGGGSSSKRFLRSCSASCVPHGAKDTEWRSVTLPRDLQSTGRQFDSSTFGGHKSEKPALPRKRAGENRSDQVTRGTVTPPPRLVKKNEEAADEVFKDIMESSPGSSPPNLTPKPLRRQVTVAPASGLPHKEEAGKGSALGTPAAAEPVTPTSKAGSGAPGGTSKGPAEESRVRRHKHSSESPGRDKGKLSRLKPAPPPPPAASAGKAGGKPSQSPSQEAAGEAVLGAKTKATSLVDAVNSDAAKPSQPGEGLKKPVLPATPKPQSAKPSGTPISPAPVPSTLPSASSALAGDQPSSTAFIPLISTRVSLRKTRQPPERIASGAITKGVVLDSTEALCLAISRNSEQMASHSAVLEAGKNLYTFCVSYVDSIQQMRNKFAFREAINKLENNLRELQICPATAGSGPAATQDFSKLLSSVKEISDIVQR

SEQ ID NO: 16580 - protein, 655 aa, Homo Sapiens
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 16581 - protein, 1863 aa, Homo Sapiens; identical to SEQ ID NO: 14811

SEQ ID NO: 16582 - protein, 3418 aa, Homo Sapiens
MPIGSKERPTFFEIFKTRCNKADLGPISLNWFEELSSEAPPYNSEPAEESEHKNNNYEPNLFKTPQRKPSYNQLASTPIIFKEQGLTLPLYQSPVKELDKFKLDLGRNVPNSRHKSLRTVKTKMDQADDVSCPLLNSCLSESPVVLQCTHVTPQRDKSVVCGSLFHTPKFVKGRQTPKHISESLGAEVDPDMSWSSSLATPPTLSSTVLIVRNEEASETVFPHDTTANVKSYFSNHDESLKKNDRFIASVTDSENTNQREAASHGFGKTSGNSFKVNSCKDHIGKSMPNVLEDEVYETVVDTSEEDSFSLCFSKCRTKNLQKVRTSKTRKKIFHEANADECEKSKNQVKEKYSFVSEVEPNDTDPLDSNVANQKPFESGSDKISKEVVPSLACEWSQLTLSGLNGAQMEKIPLLHISSCDQNISEKDLLDTENKRKKDFLTSENSLPRISSLPKSEKPLNEETVVNKRDEEQHLESHTDCILAVKQAISGTSPVASSFQGIKKSIFRIRESPKETFNASFSGHMTDPNFKKETEASESGLEIHTVCSQKEDSLCPNLIDNGSWPATTTQNSVALKNAGLISTLKKKTNKFIYAIHDETSYKGKKIPKDQKSELINCSAQFEANAFEAPLTFANADSGLLHSSVKRSCSQNDSEEPTLSLTSSFGTILRKCSRNETCSNNTVISQDLDYKEAKCNKEKLQLFITPEADSLSCLQEGQCENDPKSKKVSDIKEEVLAAACHPVQHSKVEYSDTDFQSQKSLLYDHENASTLILTPTSKDVLSNLVMISRGKESYKMSDKLKGNNYESDVELTKNIPMEKNQDVCALNENYKNVELLPPEKYMRVASPSRKVQFNQNTNLRVIQKNQEETTSISKITVNPDSEELFSDNENNFVFQVANERNNLALGNTKELHETDLTCVNEPIFKNSTMVLYGDTGDKQATQVSIKKDLVYVLAEENKNSVKQHIKMTLGQDLKSDISLNIDKIPEKNNDYMNKWAGLLGPISNHSFGGSFRTASNKEIKLSEHNIKKSKMFFKDIEEQYPTSLACVEIVNTLALDNQKKLSKPQSINTVSAHLQSSVVVSDCKNSHITPQMLFSKQDFNSNHNLTPSQKAEITELSTILEESGSQFEFTQFRKPSYILQKSTFEVPENQMTILKTTSEECRDADLHVIMNAPSIGQVDSSKQFEGTVEIKRKFAGLLKNDCNKSASGYLTDENEVGFRGFYSAHGTKLNVSTEALQKAVKLFSDIENISEETSAEVHPISLSSSKCHDSVVSMFKIENHNDKTVSEKNNKCQLILQNNIEMTTGTFVEEITENYKRNTENEDNKYTAASRNSHNLEFDGSDSSKNDTVCIHKDETDLLFTDQHNICLKLSGQFMKEGNTQIKEDLSDLTFLEVAKAQEACHGNTSNKEQLTATKTEQNIKDFETSDTFFQTASGKNISVAKESFNKIVNFFDQKPEELHNFSLNSELHSDIRKNKMDILSYEETDIVKHKILKESVPVGTGNQLVTFQGQPERDEKIKEPTLLGFHTASGKKVKIAKESLDKVKNLFDEKEQGTSEITSFSHQWAKTLKYREACKDLELACETIEITAAPKCKEMQNSLNNDKNLVSIETVVPPKLLSDNLCRQTENLKTSKSIFLKVKVHENVEKETAKSPATCYTNQSPYSVIENSALAFYTSCSRKTSVSQTSLLEAKKWLREGIFDGQPERINTADYVGNYLYENNSNSTIAENDKNHLSEKQDTYLSNSSMSNSYSYHSDEVYNDSGYLSKNKLDSGIEPVLKNVEDQKNTSFSKVISNVKDANAYPQTVNEDICVEELVTSSSPCKNKNAAIKLSISNSNNFEVGPPAFRIASGKIVCVSHETIKKVKDIFTDSFSKVIKENNENKSKICQTKIMAGCYEALDDSEDILHNSLDNDECSTHSHKVFADIQSEEILQHNQNMSGLEKVSKISPCDVSLETSDICKCSIGKLHKSVSSANTCGIFSTASGKSVQVSDASLQNARQVFSEIEDSTKQVFSKVLFKSNEHSDQLTREENTAIRTPEHLISQKGFSYNVVNSSAFSGFSTASGKQVSILESSLHKVKGVLEEFDLIRTEHSLHYSPTSRQNVSKILPRVDKRNPEHCVNSEMEKTCSKEFKLSNNLNVEGGSSENNHSIKVSPYLSQFQQDKQQLVLGTKVSLVENIHVLGKEQASPKNVKMEIGKTETFSDVPVKTNIEVCSTYSKDSENYFETEAVEIAKAFMEDDELTDSKLPSHATHSLFTCPENEEMVLSNSRIGKRRGEPLILVGEPSIKRNLLNEFDRIIENQEKSLKASKSTPDGTIKDRRLFMHHVSLEPITCVPFRTTKERQEIQNPNFTAPGQEFLSKSHLYEHLTLEKSSSNLAVSGHPFYQVSATRNEKMRHLITTGRPTKVFVPPFKTKSHFHRVEQCVRNINLEENRQKQNIDGHGSDDSKNKINDNEIHQFNKNNSNQAAAVTFTKCEEEPLDLITSLQNARDIQDMRIKKKQRQRVFPQPGSLYLAKTSTLPRISLKAAVGGQVPSACSHKQLYTYGVSKHCIKINSKNAESFQFHTEDYFGKESLWTGKGIQLADGGWLIPSNDGKAGKEEFYRALCDTPGVDPKLISRIWVYNHYRWIIWKLAAMECAFPKEFANRCLSPERVLLQLKYRYDTEIDRSRRSAIKKIMERDDTAAKTLVLCVSDIISLSANISETSSNKTSSADTQKVAIIELTDGWYAVKAQLDPPLLAVLKNGRLTVGQKIILHGAELVGSPDACTPLEAPESLMLKISANSTRPARWYTKLGFFPDPRPFPLPLSSLFSDGGNVGCVDVIIQRAYPIQWMEKTSSGLYIFRNEREEEKEAAKYVEAQQKRLEALFTKIQEEFEEHEENTTKPYLPSRALTRQQVRALQDGAELYEAVKNAADPAYLEGYFSEEQLRALNNHRQMLNDKKQAQIQLEIRKAMESAEQKEQGLSRDVTTVWKLRIVSYSKKEKDSVILSIWRPSSDLYSLLTEGKRYRIYHLATSKSKSKSERANIQLAATKKTQYQQLPVSDEILFQIYQPREPLHFSKFLDPDFQPSCSEVDLIGFVVSVVKKTGLAPFVYLSDECYNLLAIKFWIDLNEDIIKPHMLIAASNLQWRPESKSGLLTLFAGDFSVFSASPKEGHFQETFNKMKNTVENIDILCNEAENKLMHILHANDPKWSTPTKDCTSGPYTAQIIPGTGNKLLMSSPNCEIYYQSPLSLCMAKRKSVSTPVSAQMTSKSCKGEKEIDDQKNCKKRRALDFLSRLPLPPPVSPICTFVSPAAQKAFQPPRSCGTKYETPIKKKELNSPQMTPFKKFNEISLLESNSIADEELALINTQALLSGSTGEKQFISVSESTRTAPTSSEDYLRLKRRCTTSLIKEQESSQASTEECEKNKQDTITTKKYI

SEQ ID NO: 16583 - protein, 61 aa, Homo Sapiens
MKRFLFLLLTISLLVMVQIQTGLSGQNDTSQTSSPSASSNISGGIFLFFVANAIIHLFCFS

SEQ ID NO: 16584 - protein, 497 aa, Homo Sapiens [sequence omitted]

SEQ ID NO: 16585 - protein, 260 aa, Homo Sapiens [sequence omitted]

SEQ ID NO: 16586 - protein, 187 aa, Homo Sapiens
MVGSLNCIVAVSQNMGIGKNGDLPWPPLRNEFRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 16587 - protein, 1025 aa, Homo Sapiens
MAPVLSKDSADIESILALNPRTQTHATLCSTSAKKLDKKHWKRNPDKNCFNCEKLENNFDDIKHTTLGERGALREAMRCLKCADAPCQKSCPTNLDIKSFITSIANKNYYGAAKMIFSDNPLGLTCGMVCPTSDLCVGGCNLYATEEGPINIGGLQQFATEVFKAMSIPQIRNPSLPPPEKMSEAYSAKIALFGAGPASISCASFLARLGYSDITIFEKQEYVGGLSTSEIPQFRLPYDVVNFEIELMKDLGVKIICGKSLSVNEMTLSTLKEKGYKAAFIGIGLPEPNKDAIFQGLTQDQGFYTSKDFLPLVAKGSKAGMCACHSPLPSIRGVVIVLGAGDTAFDCATSALRCGARRVFIVFRKGFVNIRAVPEEMELAKEEKCEFLPFLSPRKVIVKGGRIVAMQFVRTEQDETGKWNEDEDQMVHLKADVVISAFGSVLSDPKVKEALSPIKFNRWGLPEVDPETMQTSEAWVFAGGDVVGLANTTVESVNDGKQASWYIHKYVQSQYGASVSAKPELPLFYTPIDLVDISVEMAGLKFINPFGLASATPATSTSMIRRAFEAGWGFALTKTFSLDKDIVTNVSPRIIRGTTSGPMYGPGQSSFLNIELISEKTAAYWCQSVTELKADFPDNIVIASIMCSYNKNDWTELAKKSEDSGADALELNLSCPHGMGERGMGLACGQDPELVRNICRWVRQAVQIPFFAKLTPNVTDIVSIARAAKEGGANGVTATNTVSGLMGLKSDGTPWPAVGIAKRTTYGGVSGTAIRPIALRAVTSIARALPGFPILATGGIDSAESGLQFLHSGASVLQVCSAIQNQDFTVIEDYCTGLKALLYLKSIEELQDWDGQSPATVSHQKGKPVPRIAELMDKKLPSFGPYLEQRKKIIAENKIRLKEQNVAFSPLKRNCFIPKRPIPTIKDVIGKALQYLGTFGELSNVEQVVAMIDEEMCINCGKCYMTCNDSGYQAIQFDPETHLPTITDTCTGCTLCLSVCPIVDCIKMVSRTTPYEPKRGVPLSVNPVC

SEQ ID NO: 16588 - protein, 1210 aa, Homo Sapiens [sequence omitted]

SEQ ID NO: 16589 - protein, 297 aa, Homo Sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLTTFGSLEQLIAASREDLALCPGLGPQKARRLFDVLHEPFLKVP

SEQ ID NO: 16590 - protein, 595 aa, Homo Sapiens [sequence omitted]

SEQ ID NO: 16591 - protein, 254 aa, Homo Sapiens; identical to SEQ ID NO: 5200

SEQ ID NO: 16592 - protein, 1255 aa, Homo Sapiens [sequence omitted]

SEQ ID NO: 16593 - protein, 1367 aa, Homo Sapiens
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 16594 - protein, 189 aa, Homo Sapiens [sequence omitted]

SEQ ID NO: 16595 - protein, 1280 aa, Homo Sapiens
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 16596 - protein, 207 aa, Homo Sapiens
MDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 16597 - protein, 1531 aa, Homo Sapiens
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 16598 - protein, 933 aa, Homo Sapiens; identical to SEQ ID NO: 15481

SEQ ID NO: 16599 - protein, 173 aa, Homo Sapiens
MQSELCFADIHDSDGSSSSSHQSLKSTAKWAASLENLLEDPEGVKRFREFLKKEFSEENVLFWLACEDFKKMQDKTQMQEKAKEIYMTFLSSKASSQVNVEGQSRLNEKILEEPHPLMFQKLQDQIFNLMKYDSYSRFLKSDLFLKHKRTEEEEEDLPDAQTAAKRASRIYNT

SEQ ID NO: 16600 - protein, 225 aa, Homo Sapiens
MVTHSKFPAAGMSRPLDTSLRLKTFSSKSEYQLVVNAVRKLQESGFYWSAVTGGEANLLLSAEPAGTFLIRDSSDQRHFFTLSVKTQSGTKNLRIQCEGGSFSLQSDPRSTQPVPRFDCVLKLVHHYMPPPGAPSFPSPPTEPSSEVPEQPSAQPLPGSPPRRAYYIYSGGEKIPLVLSRPLSSNVATLQHLCRKTVNGHLDSYEKVTQLPGPIREFLDQYDAPL

SEQ ID NO: 16601 - protein, 313 aa, Homo Sapiens
MPVAGSELPRRPLPPAAQERDAEPRPPHGELQYLGQIQHILRCGVRKDDRTGTGTLSVFGMQARYSLRDEFPLLTTKRVFWKGVLEELLWFIKGSTNAKELSSKGVKIWDANGSRDFLDSLGFSTREEGDLGPVYGFQWRHFGAEYRDMESDYSGQGVDQLQRVIDTIKTNPDDRRIIMCAWNPRDLPLMALPPCHALCQFYVVNSELSCQLYQRSGDMGLGVPFNIASYALLTYMIAHITGLKPGDFIHTLGDAHIYLNHIEPLKIQLQREPRPFPKLRILRKVEKIDDFKAEDFQIEGYNPHPTIKMEMAV

SEQ ID NO: 16602 - protein, 533 aa, Homo Sapiens
MAVESQGGRPLVLGLLLCVLGPVVSHAGKILLIPVDGSHWLSMLGAIQQLQQRGHEIVVLAPDASLYIRDGAFYTLKTYPVPFQREDVKESFVSLGHNVFENDSFLQRVIKTYKKIKKDSAMLLSGCSHLLHNKELMASLAESSFDVMLTDPFLPCSPIVAQYLSLPTVFFLHALPCSLEFEATQCPNPFSYVPRPLSSHSDHMTFLQRVKNMLIAFSQNFLCDVVYSPYATLASEFLQREVTVQDLLSSASVWLFRSDFVKDYPRPIMPNMVFVGGINCLHQNPLSQEFEAYINASGEHGIVVFSLGSMVSEIPEKKAMAIADALGKIPQTVLWRYTGTRPSNLANNTILVKWLPQNDLLGHPMTRAFITHAGSHGVYESICNGVPMVMMPLFGDQMDNAKRMETKGAGVTLNVLEMTSEDLENALKAVINDKSYKENIMRLSSLHKDRPVEPLDLAVFWVEFVMRHKGAPHLRPAAHDLTWYQYHSLDVIGFLLAVVLTVAFITFKCCAYGYRKCLGKKGRVKKAHKSKTH

SEQ ID NO: 16603 - protein, 2002 aa, Homo Sapiens; identical to SEQ ID NO: 15749

SEQ ID NO: 16604 - protein, 912 aa, Homo Sapiens; identical to SEQ ID NO: 14891

SEQ ID NO: 16605 - protein, 193 aa, Homo Sapiens
MAAIRKKLVIVGDGACGKTCLLIVFSKDQFPEVYVPTVFENYVADIEVDGKQVELALWDTAGQEDYDRLRPLSYPDTDVILMCFSIDSPDSLENIPEKWTPEVKHFCPNVPIILVGNKKDLRNDEHTRRELAKMKQEPVKPEEGRDMANRIGAFGYMECSAKTKDGVREVFEMATRAALQARRGKKKSGCLVL

SEQ ID NO: 16606 - protein, 845 aa, Homo Sapiens
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMKEALGTPGAANLYQVFIKYKERFLVYGRYCSQVESASKHLDRVAAAREDVQMKLEECSQRANNGRFTLRDLLMVPMQRVLKYHLLLQELVKHTQEAMEKENLRLALDAMRDLAQCVNEVKRDNETLRQITNFQLSIENLDQSLAHYGRPKIDGELKITSVERRSKMDRYAFLLDKALLICKRRGDSYDLKDFVNLHSFQVRDDSSGDRDNKKWSHMFLLIEDQGAQGYELFFKTRELKKKWMEQFEMAISNIYPENATANGHDFQMFSFEETTSCKACQMLLRGTFYQGYRCHRCRASAHKECLGRVPPCGRHGQDFPGTMKKDKLHRRAQDKKRNELGLPKMEVFQEYYGLPPPPGAIGPFLRLNPGDIVELTKAEAEQNWWEGRNTSTNEIGWFPCNRVKPYVHGPPQDLSVHLWYAGPMERAGAESILANRSDGTFLVRQRVKDAAEFAISIKYNVEVKHIKIMTAEGLYRITEKKAFRGLTELVEFYQQNSLKDCFKSLDTTLQFPFKEPEKRTISRPAVGSTKYFGTAKARYDFCARDRSELSLKEGDIIKILNKKGQQGWWRGEIYGRVGWFPANYVEEDYSEYC

SEQ ID NO: 16607 - protein, 158 aa, Homo Sapiens
MSSAIERKSLDPSEEPVDEVLQIPPSLLTCGGCQQNIGDRYFLKAIDQYWHEDCLSCDLCGCRLGEVGRRLYYKLGRKLCRRDYLRLFGQDGLCASCDKRIRAYEMTMRVKDKVYHLECFKCAACQKHFCVGDRYLLINSDIVCEQDIYEWTKINGMI

SEQ ID NO: 16608 - protein, 331 aa, Homo Sapiens; identical to SEQ ID NO: 15705

SEQ ID NO: 16609 - protein, 211 aa, Homo Sapiens
MVAHNQVAADNAVSTAAEPRRRPEPSSSSSSSPAAPARPRPCPAVPAPAPGDTHFRTFRSHADYRRITRASALLDACGFYWGPLSVHGAHERLRAEPVGTFLVRDSRQRNCFFALSVKMASGPTSIRVHFQAGRFHLDGSRESFDCLFELLEHYVAAPRRMLGAPLRQRRVRPLQELCRQRIVATVGRENLARIPLNPVLRDYLSSFPFQI

SEQ ID NO: 16610 - protein, 283 aa, Homo Sapiens; identical to SEQ ID NO: 13574

SEQ ID NO: 16611 - protein, 337 aa, Homo Sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 16612 - protein, 1755 aa, Homo Sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGPHIPSSLASPMRLSTPSASPAIPPLVHCADKSLPWKMGVSPGNPVDSHAYPHIQNSKQPRVPSAKAVTSGLPGDTALLLPPSPRPSPRVHLPTQPAADTYSEFHKHYARISTSPSVALSKPYMTVSSEFPAARLSNGKYPKAPEGGEGAQPVPGHARKTAVQDRKDGSSPPLLEKQTVTKDVTDKPLDLSSKVVDVDASKADHMKKMAPTVLVHSRAGSGLVLSGSEIPKETLSPPGNGCAIYRSEIISTAPSSWVVPGPSPNEENNGKSMSLKNKALDWAIPQQRSSSCPRMGGTDAVITNVSGSVSSAGRPASASPAPNANADGTKTSRSSVETTPSVIQHVGQPPATPAKHSSSTSSKGAKASNPEPSFKANENGLPPSSIFLSPNEAFRSPPIPYPRSYLPYPAPEGIAVSPLSLHGKGPVYPHPVLLPNGSLFPGHLAPKPGLPYGLPTGRPEFVTYQDALGLGMVHPMLIPHTPIEITKEEKPERRSRSHERARYEDPTLRNRFSEILETSSTKLHPDVPTDKNLKPNPNWNQGKTVVKSDKLVYVDLLREEPDAKTDTNVSKPSFAAESVGQSAEPPKPSVEPALQQHRDFIALREELGRISDFHETYTFKQPVFTVSKDSVLAGTNKENLGLPVSTPFLEPPLGSDGPAVTFGKTQEDPKPFCVGSAPPSVDVTPTYTKDGADEAESNDGKVLKPKPSKLAKRIANSAGYVGDRFKCVTTELYADSSQLSREQRALQMEGLQEDSILCLPAAYCERAMMRFSELEMKEREGGHPATKDSEMCKFSPADWERLKGNQDKKPKSVTLEEAIAEQNESERCEYSVGNKHRDPFEAPEDKDLPVEKYFVERQPVSEPPADQVASDMPHSPTLRVDRKRKVSGDSSHTETTAEEVPEDPLLKAKRRRVSKDDWPEREMTNSSSNHLEDPHYSELTNLKVCIELTGLHPKKQRHLLHLRERWEQQVSAADGKPGRQSRKEVTQATQPEAIPQGTNITEEKPGRKRAEAKGNRSWSEESLKPSDNEQGLPVFSGSPPMKSLSSTSAGGKKQAQPSCAPASRPPAKQQKIKENQKTDVLCADEEEDCQAASLLQKYTDNSEKPSGKRLCKTKHLIPQESRRGLPLTGEYYVENADGKVTVRRFRKRPEPSSDYDLSPAKQEPKPFDRLQQLLPASQSTQLPCSSSPQETTQSRPMPPEARRLIVNKNAGETLLQRAARLGYEEVVLYCLENKICDVNHRDNAGYCALHEACARGWLNIVRHLLEYGADVNCSAQDGTRPLHDAVENDHLEIVRLLLSYGADPTLATYSGRTIMKMTHSELMEKFLTDYLNDLQGRNDDDASGTWDFYGSSVCEPDDESGYDVLANPPGPEDQDDDDDAYSDVFEFEFSETPLLPCYNIQVSVAQGPRNWLLLSDVLKKLKMSSRIFRCNFPNVEIVTIAEAEFYRQVSASLLFSCSKDLEAFNPESKELLDLVEFTNEIQTLLGSSVEWLHPSDLASDNYW

SEQ ID NO: 16613 - protein, 289 aa, Homo Sapiens; identical to SEQ ID NO: 14650

SEQ ID NO: 16614 - protein, 664 aa, Homo Sapiens; identical to SEQ ID NO: 12683

SEQ ID NO: 16615 - protein, 303 aa, Homo Sapiens; identical to SEQ ID NO: 15310

SEQ ID NO: 16616 - protein, 254 aa, Homo Sapiens; identical to SEQ ID NO: 14707

SEQ ID NO: 16617 - protein, 417 aa, Homo Sapiens; identical to SEQ ID NO: 13599

SEQ ID NO: 16618 - protein, 250 aa, Homo Sapiens [sequence omitted]

SEQ ID NO: 16619 - protein, 168 aa, Homo Sapiens
MFQIPEFEPSEQEDSSSAERGLGPSPAGDGPSGSGKHHRQAPGLLWDASHQQEQPTSSSHHGGAGAVEIRSRHSSYPAGTEDDEGMGEEPSPFRGRSRSAPPNLWAAQRYGRELRRMSDEFVDSFKKGLPRPKSAGTATQMRQSSSWTRVFQSWWDRNLGRGSSAPSQ

SEQ ID NO: 16620 - protein, 184 aa, Homo Sapiens
MLQMAGQCSQNEYFDSLLHACIPCQLRCSSNTPPLTCQRYCNASVTNSVKGTNAILWTCLGLSLIISLAVFVLMFLLRKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 16621 - protein, 96 aa, Homo Sapiens; identical to SEQ ID NO: 2120

SEQ ID NO: 16622 - protein, 97 aa, Homo Sapiens; identical to SEQ ID NO: 2121

SEQ ID NO: 16623 - protein, 98 aa, Homo Sapiens; identical to SEQ ID NO: 2122

SEQ ID NO: 16624 - protein, 93 aa, Homo Sapiens; identical to SEQ ID NO: 2126

SEQ ID NO: 16625 - protein, 113 aa, Homo Sapiens
MKVSVAALSCLMLVAVLGSQAQFINDAETELMMSKLPLENPVVLNSFHFAADCCTSYISQSIPCSLMKSYFETSSECSKPGVIFLTKKGRQVCAKPSGPGVQDCMKKLKPYSI

SEQ ID NO: 16626 - protein, 120 aa, Homo Sapiens; identical to SEQ ID NO: 2130

SEQ ID NO: 16627 - protein, 94 aa, Homo Sapiens; identical to SEQ ID NO: 2133

SEQ ID NO: 16628 - protein, 89 aa, Homo Sapiens; identical to SEQ ID NO: 2135

SEQ ID NO: 16629 - protein, 98 aa, Homo Sapiens; identical to SEQ ID NO: 2137

SEQ ID NO: 16630 - protein, 99 aa, Homo Sapiens; identical to SEQ ID NO: 2138

SEQ ID NO: 16631 - protein, 96 aa, Homo Sapiens; identical to SEQ ID NO: 2141

SEQ ID NO: 16632 - protein, 134 aa, Homo Sapiens; identical to SEQ ID NO: 2144

SEQ ID NO: 16633 - protein, 93 aa, Homo Sapiens; identical to SEQ ID NO: 2145

SEQ ID NO: 16634 - protein, 120 aa, Homo Sapiens
MKVSVAALSCLMLVTALGSQARVTKDAETEFMMSKLPLENPVLLDRFHATSADCCISYTPRSIPCSLLESYFETNSECSKPGVIFLTKKGRRFCANPSDKQVQVCVRMLKLDTRIKTRKN

SEQ ID NO: 16635 - protein, 119 aa, Homo Sapiens; identical to SEQ ID NO: 2149

SEQ ID NO: 16636 - protein, 150 aa, Homo Sapiens; identical to SEQ ID NO: 2152

SEQ ID NO: 16637 - protein, 94 aa, Homo Sapiens; identical to SEQ ID NO: 2155

SEQ ID NO: 16638 - protein, 112 aa, Homo Sapiens; identical to SEQ ID NO: 2157

SEQ ID NO: 16639 - protein, 127 aa, Homo Sapiens; identical to SEQ ID NO: 2159

SEQ ID NO: 16640 - protein, 92 aa, Homo Sapiens; identical to SEQ ID NO: 2161

SEQ ID NO: 16641 - protein, 92 aa, Homo Sapiens; identical to SEQ ID NO: 2163

SEQ ID NO: 16642 - protein, 91 aa, Homo Sapiens; identical to SEQ ID NO: 2175

SEQ ID NO: 16643 - protein, 99 aa, Homo Sapiens; identical to SEQ ID NO: 2180

SEQ ID NO: 16644 - protein, 99 aa, Homo Sapiens; identical to SEQ ID NO: 2181

SEQ ID NO: 16645 - protein, 355 aa, Homo Sapiens
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 16646 - protein, 362 aa, Homo Sapiens
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 16647 - protein, 350 aa, Homo Sapiens
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 16648 - protein, 374 aa, Homo Sapiens
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 16649 - protein, 355 aa, Homo Sapiens
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 16650 - protein, 360 aa, Homo Sapiens
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 16651 - protein, 352 aa, Homo Sapiens [sequence omitted]

SEQ ID NO: 16652 - protein, 374 aa, Homo Sapiens
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 16653 - protein, 378 aa, Homo Sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 16654 - protein, 355 aa, Homo Sapiens
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 16655 - protein, 369 aa, Homo Sapiens
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 16656 - protein, 836 aa, Homo Sapiens
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 16657 - protein, 972 aa, Homo Sapiens; identical to SEQ ID NO: 3582

SEQ ID NO: 16658 - protein, 400 aa, Homo Sapiens; identical to SEQ ID NO: 3591

SEQ ID NO: 16659 - protein, 976 aa, Homo Sapiens [sequence omitted]

SEQ ID NO: 16660 - protein, 1097 aa, Homo Sapiens; identical to SEQ ID NO: 7860

SEQ ID NO: 16661 - protein, 455 aa, Homo Sapiens; identical to SEQ ID NO: 13589

SEQ ID NO: 16662 - protein, 461 aa, Homo Sapiens; identical to SEQ ID NO: 13591

SEQ ID NO: 16663 - protein, 569 aa, Homo Sapiens; identical to SEQ ID NO: 6962

SEQ ID NO: 16664 - protein, 551 aa, Homo Sapiens; identical to SEQ ID NO: 7030

SEQ ID NO: 16665 - protein, 378 aa, Homo Sapiens; identical to SEQ ID NO: 7076

SEQ ID NO: 16666 - protein, 825 aa, Homo Sapiens; identical to SEQ ID NO: 7097

SEQ ID NO: 16667 - protein, 468 aa, Homo Sapiens; identical to SEQ ID NO: 7125

SEQ ID NO: 16668 - protein, 459 aa, Homo Sapiens [sequence omitted]

SEQ ID NO: 16669 - protein, 918 aa, Homo Sapiens; identical to SEQ ID NO: 7130

SEQ ID NO: 16670 - protein, 369 aa, Homo Sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 16671 - protein, 234 aa, Homo Sapiens
MDPGLQQALNGMAPPGDTAMHVPAGSVASHLGTTSRSYFYLTTATLALCLVFTVATIMVLVVQRTDSIPNSPDNVPLKGGNCSEDLLCILKRAPFKKSWAYLQVAKHLNKTKLSWNKDGILHGVRYQDGNLVIQFPGLYFIICQLQFLVQCPNNSVDLKLELLINKHIKKQALVTVCESGMQTKHVYQNLSQFLLDYLQVNTTISVNVDTFQYIDTSTFPLENVLSIFLYSNSD

SEQ ID NO: 16672 - protein, 261 aa, Homo Sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 16673 - protein, 281 aa, Homo Sapiens; identical to SEQ ID NO: 16510

SEQ ID NO: 16674 - protein, 662 aa, Homo Sapiens; identical to SEQ ID NO: 6869

SEQ ID NO: 16675 - protein, 427 aa, Homo Sapiens; identical to SEQ ID NO: 6880

SEQ ID NO: 16676 - protein, 380 aa, Homo Sapiens
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 16677 - protein, 272 aa, Homo Sapiens
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQVAVAGCVFLLISVLLLSGLTWQRRQRKSRRTI

SEQ ID NO: 16678 - protein, 260 aa, Homo Sapiens
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 16679 - protein, 595 aa, Homo Sapiens
MRVLLAALGLLFLGALRAFPQDRPFEDTCHGNPSHYYDKAVRRCCYRCPMGLFPTQQCPQRPTDCRKQCEPDYYLDEADRCTACVTCSRDDLVEKTPCAWNSSRVCECRPGMFCSTSAVNSCARCFFHSVCPAGMIVKFPGTAQKNTVCEPASPGVSPACASPENCKEPSSGTIPQAKPTPVSPATSSASTMPVRGGTRLAQEAASKLTRAPDSPSSVGRPSSDPGLSPTQPCPEGSGDCRKQCEPDYYLDEAGRCTACVSCSRDDLVEKTPCAWNSSRTCECRPGMICATSATNSCARCVPYPICAAETVTKPQDMAEKDTTFEAPPLGTQPDCNPTPENGEAPASTSPTQSLLVDSQASKTLPIPTSAPVALSSTGKPVLDAGPVLFWVILVLVVVVGSSAFLLCHRRACRKRIRQKLHLCYPVQTSQPKLELVDSRPRRSSTQLRSGASVTEPVAEERGLMSQPLMETCHSVGAAYLESLPLQDASPAGGPSSPRDLPEPRVSTEHTNNKIEKIYIMKADTVIVGTVKAELPEGRGLAGPAEPELEEELEADHTPHYPEQETEPPLGSCSDVMLSVEEEGKEDPLPTAASGK

SEQ ID NO: 16680 - protein, 458 aa, Homo Sapiens; identical to SEQ ID NO: 2334

SEQ ID NO: 16681 - protein, 277 aa, Homo Sapiens; identical to SEQ ID NO: 2337

SEQ ID NO: 16682 - protein, 193 aa, Homo Sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 16683 - protein, 335 aa, Homo Sapiens; identical to SEQ ID NO: 5109

SEQ ID NO: 16684 - protein, 400 aa, Homo Sapiens; identical to SEQ ID NO: 3591

SEQ ID NO: 16685 - protein, 489 aa, Homo Sapiens; identical to SEQ ID NO: 6747

SEQ ID NO: 16686 - protein, 398 aa, Homo Sapiens; identical to SEQ ID NO: 6966

SEQ ID NO: 16687 - protein, 897 aa, Homo Sapiens
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 16688 - protein, 897 aa, Homo Sapiens; identical to SEQ ID NO: 16687

SEQ ID NO: 16689 - protein, 255 aa, Homo Sapiens; identical to SEQ ID NO: 14706

SEQ ID NO: 16690 - protein, 578 aa, Homo Sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 16691 - protein, 866 aa, Homo Sapiens; identical to SEQ ID NO: 6906

SEQ ID NO: 16692 - protein, 397 aa, Homo Sapiens; identical to SEQ ID NO: 3787

SEQ ID NO: 16693 - protein, 355 aa, Homo Sapiens
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 16694 - protein, 107 aa, Homo Sapiens; identical to SEQ ID NO: 3795

SEQ ID NO: 16695 - protein, 98 aa, Homo Sapiens; identical to SEQ ID NO: 3796

SEQ ID NO: 16696 - protein, 94 aa, Homo Sapiens; identical to SEQ ID NO: 3797

SEQ ID NO: 16697 - protein, 93 aa, Homo Sapiens; identical to SEQ ID NO: 3801

SEQ ID NO: 16698 - protein, 109 aa, Homo Sapiens; identical to SEQ ID NO: 3805

SEQ ID NO: 16699 - protein, 111 aa, Homo Sapiens; identical to SEQ ID NO: 3807

SEQ ID NO: 16700 - protein, 254 aa, Homo Sapiens
MGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 16701 - protein, 107 aa, Homo Sapiens; identical to SEQ ID NO: 3810

SEQ ID NO: 16702 - protein, 107 aa, Homo Sapiens; identical to SEQ ID NO: 3811

SEQ ID NO: 16703 - protein, 101 aa, Homo Sapiens; identical to SEQ ID NO: 10258

SEQ ID NO: 16704 - protein, 114 aa, Homo Sapiens; identical to SEQ ID NO: 3812

SEQ ID NO: 16705 - protein, 114 aa, Homo Sapiens; identical to SEQ ID NO: 3814

SEQ ID NO: 16706 - protein, 128 aa, Homo Sapiens; identical to SEQ ID NO: 10670

SEQ ID NO: 16707 - protein, 99 aa, Homo Sapiens; identical to SEQ ID NO: 3816

SEQ ID NO: 16708 - protein, 125 aa, Homo Sapiens; identical to SEQ ID NO: 3817

SEQ ID NO: 16709 - protein, 350 aa, Homo Sapiens
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 16710 - protein, 360 aa, Homo Sapiens
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 16711 - protein, 368 aa, Homo Sapiens
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 16712 - protein, 352 aa, Homo Sapiens
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 16713 - protein, 372 aa, Homo Sapiens
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 16714 - protein, 342 aa, Homo Sapiens
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 16715 - protein, 362 aa, Homo Sapiens
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 16716 - protein, 336 aa, Homo Sapiens
MGNCLHRAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 16717 - protein, 193 aa, Homo Sapiens; identical to SEQ ID NO: 4835

SEQ ID NO: 16718 - protein, 508 aa, Homo Sapiens
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 16719 - protein, 993 aa, Homo Sapiens
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 16720 - protein, 235 aa, Homo Sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 16721 - protein, 836 aa, Homo Sapiens; identical to SEQ ID NO: 16656

SEQ ID NO: 16722 - protein, 241 aa, Homo Sapiens; identical to SEQ ID NO: 13579

SEQ ID NO: 16723 - protein, 199 aa, Homo Sapiens; identical to SEQ ID NO: 14709

SEQ ID NO: 16724 - protein, 897 aa, Homo Sapiens; identical to SEQ ID NO: 16687

SEQ ID NO: 16725 - protein, 918 aa, Homo Sapiens; identical to SEQ ID NO: 7130

SEQ ID NO: 16726 - protein, 283 aa, Homo Sapiens; identical to SEQ ID NO: 13574

SEQ ID NO: 16727 - protein, 166 aa, Homo Sapiens; identical to SEQ ID NO: 6744

SEQ ID NO: 16728 - protein, 337 aa, Homo Sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 16729 - protein, 189 aa, Homo Sapiens; identical to SEQ ID NO: 6725

SEQ ID NO: 16730 - protein, 187 aa, Homo Sapiens; identical to SEQ ID NO: 6742

SEQ ID NO: 16731 - protein, 271 aa, Homo Sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLAGGPPSITDFQILENQA

SEQ ID NO: 16732 - protein, 178 aa, Homo Sapiens; identical to SEQ ID NO: 6848

SEQ ID NO: 16733 - protein, 578 aa, Homo Sapiens; identical to SEQ ID NO: 16690

SEQ ID NO: 16734 - protein, 199 aa, Homo Sapiens; identical to SEQ ID NO: 6850

SEQ ID NO: 16735 - protein, 422 aa, Homo Sapiens; identical to SEQ ID NO: 6858

SEQ ID NO: 16736 - protein, 219 aa, Homo Sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 16737 - protein, 146 aa, Homo Sapiens [sequence omitted]

SEQ ID NO: 16738 - protein, 427 aa, Homo Sapiens; identical to SEQ ID NO: 6880

SEQ ID NO: 16739 - protein, 546 aa, Homo Sapiens
MKNQDKKNGAAKQSNPKSSPGQPEAGPEGAQERPSQAAPAVEAEGPGSSQAPRKPEGAQARTAQSGALRDVSEELSRQLEDILSTYCVDNNQGGPGEDGAQGEPAEPEDAEKSRTYVARNGEPEPTPVVNGEKEPSKGDPNTEEIRQSDEVGDRDHRRPQEKKKAKGLGKEITLLMQTLNTLSTPEEKLAALCKKYAELLEEHRNSQKQMKLLQKKQSQLVQEKDHLRGEHSKAVLARSKLESLCRELQRHNRSLKEEGVQRAREEEEKRKEVTSHFQVTLNDIQLQMEQHNERNSKLRQENMELAERLKKLIEQYELREEHIDKVFKHKDLQQQLVDAKLQQAQEMLKEAEERHQREKDFLLKEAVESQRMCELMKQQETHLKQQLALYTEKFEEFQNTLSKSSEVFTTFKQEMEKMTKKIKKLEKETTMYRSRWESSNKALLEMAEEKTVRDKELEGLQVKIQRLEKLCRALQTERNDLNKRVQDLSAGGQGSLTDSGPERRPEGPGAQAPSSPRVTEAPCYPGAPSTEASGQTGPQEPTSARA

SEQ ID NO: 16740 - protein, 162 aa, Homo Sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 16741 - protein, 267 aa, Homo Sapiens; identical to SEQ ID NO: 6891

SEQ ID NO: 16742 - protein, 1332 aa, Homo Sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAAAADGRLQEGDEILELNGESMAGLTHQDALQKFKQAKKGLLTLTVRTRLTAPPSLCSHLSPPLCRSLSSSTCITKDSSSFALESPSAPISTAKPNYRIMVEVSLQKEAGVGLGIGLCSVPYFQCISGIFVHTLSPGSVAHLDGRLRCGDEIVEISDSPVHCLTLNEVYTILSHCDPGPVPIIVSRHPDPQVSEQQLKEAVAQAVENTKFGKERHQWSLEGVKRLESSWHGRPTLEKEREKNSAPPHRRAQKVMIRSSSDSSYMSGSPGGSPGSGSAEKPSSDVDISTHSPSLPLAREPVVLSIASSRLPQESPPLPESRDSHPPLRLKKSFEILVRKPMSSKPKPPPRKYFKSDSDPQKSLEERENSSCSSGHTPPTCGQEARELLPLLLPQEDTAGRSPSASAGCPGPGIGPQTKSSTEGEPGWRRASPVTQTSPIKHPLLKRQARMDYSFDTTAEDPWVRISDCIKNLFSPIMSENHGHMPLQPNASLNEEEGTQGHPDGTPPKLDTANGTPKVYKSADSSTVKKGPPVAPKPAWFRQSLKGLRNRASDPRGLPDPALSTQPAPASREHLGSHIRASSSSSSIRQRISSFETFGSSQLPDKGAQRLSLQPSSGEAAKPLGKHEEGRFSGLLGRGAAPTLVPQQPEQVLSSGSPAASEARDPGVSESPPPGRQPNQKTLPPGPDPLLRLLSTQAEESQGPVLKMPSQRARSFPLTRSQSCETKLLDEKTSKLYSISSQVSSAVMKSLLCLPSSISCAQTPCIPKEGASPTSSSNEDSAANGSAETSALDTGFSLNLSELREYTEGLTEAKEDDDGDHSSLQSGQSVISLLSSEELKKLIEEVKVLDEATLKQLDGIHVTILHKEEGAGLGFSLAGGADLENKVITVHRVFPNGLASQEGTIQKGNEVLSINGKSLKGTTHHDALAILRQAREPRQAVIVTRKLTPEAMPDLNSSTDSAASASAASDVSVESTAEATVCTVTLEKMSAGLGFSLEGGKGSLHGDKPLTINRIFKGAASEQSETVQPGDEILQLGGTAMQGLTRFEAWNIIKALPDGPVTIVIRRKSLQSKETTAAGDS

SEQ ID NO: 16743 - protein, 155 aa, Homo Sapiens; identical to SEQ ID NO: 6899

SEQ ID NO: 16744 - protein, 866 aa, Homo Sapiens; identical to SEQ ID NO: 6906

SEQ ID NO: 16745 - protein, 193 aa, Homo Sapiens
MAAEPVEDNCINFVAMKFIDNTLYFIAEDDENLESDYFGKLESKLSVIRNLNDQVLFIDQGNRPLFEDMTDSDCRDNAPRTIFIISMYKDSQPRGMAVTISVKCEKISTLSCENKIISFKEMNPPDNIKDTKSDIIFFQRSVPGHDNKMQFESSSYEGYFLACEKERDLFKLILKKEDELGDRSIMFTVQNED

SEQ ID NO: 16746 - protein, 569 aa, Homo Sapiens; identical to SEQ ID NO: 6962

SEQ ID NO: 16747 - protein, 271 aa, Homo Sapiens; identical to SEQ ID NO: 16731

SEQ ID NO: 16748 - protein, 269 aa, Homo Sapiens
MAEVPELASEMMAYYSGNEDDLFFEADGPKQMKCSFQDLDLCPLDGGIQLRISDHHYSKGFRQAASVVVAMDKLRKMLVPCPQTFQENDLSTFFPFIFEEEPIFFDTWDNEAYVHDAPVRSLNCTLRDSQQKSLVMSGPYELKALHLQGQDMEQQVVFSMSFVQGEESNDKIPVALGLKEKNLYLSCVLKDDKPTLQLESVDPKNYPKKKMEKRFVFNKIEINNKLEFESAQFPNWYISTSQAENMPVFLGGTKGGQDITDFTMQFVSS

SEQ ID NO: 16749 - protein, 153 aa, Homo Sapiens; identical to SEQ ID NO: 6997

SEQ ID NO: 16750 - protein, 176 aa, Homo Sapiens; identical to SEQ ID NO: 6998

SEQ ID NO: 16751 - protein, 553 aa, Homo Sapiens; identical to SEQ ID NO: 7004

SEQ ID NO: 16752 - protein, 311 aa, Homo Sapiens
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 16753 - protein, 155 aa, Homo Sapiens
MERIVICLMVIFLGTLVHKSSSQGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 16754 - protein, 152 aa, Homo Sapiens; identical to SEQ ID NO: 7032

SEQ ID NO: 16755 - protein, 229 aa, Homo Sapiens; identical to SEQ ID NO: 4493

SEQ ID NO: 16756 - protein, 153 aa, Homo Sapiens [sequence omitted]

SEQ ID NO: 16757 - protein, 825 aa, Homo Sapiens; identical to SEQ ID NO: 7097

SEQ ID NO: 16758 - protein, 134 aa, Homo Sapiens; identical to SEQ ID NO: 7105

SEQ ID NO: 16759 - protein, 420 aa, Homo Sapiens; identical to SEQ ID NO: 7108

SEQ ID NO: 16760 - protein, 212 aa, Homo Sapiens; identical to SEQ ID NO: 7120

SEQ ID NO: 16761 - protein, 468 aa, Homo Sapiens; identical to SEQ ID NO: 7125

SEQ ID NO: 16762 - protein, 177 aa, Homo Sapiens; identical to SEQ ID NO: 7141

SEQ ID NO: 16763 - protein, 521 aa, Homo Sapiens
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 16764 - protein, 202 aa, Homo Sapiens; identical to SEQ ID NO: 7856

SEQ ID NO: 16765 - protein, 1097 aa, Homo Sapiens; identical to SEQ ID NO: 7860

SEQ ID NO: 16766 - protein, 240 aa, Homo Sapiens
MEESVVRPSVFVVDGQTDIPFTRLGRSHRRQSCSVARVGLGLLLLLMGAGLAVQGWFLLQLHWRLGEMVTRLPDGPAGSWEQLIQERRSHEVNPAAHLTGANSSLTGSGGPLLWETQLGLAFLRGLSYHDGALVVTKAGYYYIYSKVQLGGVGCPLGLASTITHGLYKRTPRYPEELELLVSQQSPCGRATSSSRVWWDSSFLGGVVHLEAGEKVVVRVLDERLVRLRDGTRSYFGAFMV

SEQ ID NO: 16767 - protein, 435 aa, Homo Sapiens; identical to SEQ ID NO: 8143

SEQ ID NO: 16768 - protein, 244 aa, Homo Sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 16769 - protein, 554 aa, Homo Sapiens; identical to SEQ ID NO: 3577

SEQ ID NO: 16770 - protein, 401 aa, Homo Sapiens; identical to SEQ ID NO: 13563

SEQ ID NO: 16771 - protein, 252 aa, Homo Sapiens; identical to SEQ ID NO: 9855

SEQ ID NO: 16772 - protein, 979 aa, Homo Sapiens; identical to SEQ ID NO: 9857

SEQ ID NO: 16773 - protein, 277 aa, Homo Sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPGGGSFRTPIQEEQADAHSTLAKI

SEQ ID NO: 16774 - protein, 183 aa, Homo Sapiens
MERVQPLEENVGNAARPRFERNKLLLVASVIQGLGLLLCFTYICLHFSALQVSHRYPRIQSIKVQFTEYKKEKGFILTSQKEDEIMKVQNNSVIINCDGFYLISLKGYFSQEVNISLHYQKDEEPLFQLKKVRSVNSLMVASLTYKDKVYLNVTTDNTSLDDFHVNGGELILIHQNPGEFCVL

SEQ ID NO: 16775 - protein, 616 aa, Homo Sapiens; identical to SEQ ID NO: 13557

SEQ ID NO: 16776 - protein, 273 aa, Homo Sapiens
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 16777 - protein, 293 aa, Homo Sapiens
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYSTLGLCLCAVLCCFLVAVACFLKKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 16778 - protein, 285 aa, Homo Sapiens
MDDSTEREQSRLTSCLKKREEMKLKECVSILPRKESPSVRSSKDGKLLAATLLLALLSCCLTVVSFYQVAALQGDLASLRAELQGHHAEKLPAGAGAPKAGLEEAPAVTAGLKIFEPPAPGEGNSSQNSRNKRAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLL

SEQ ID NO: 16779 - protein, 503 aa, Homo Sapiens; identical to SEQ ID NO: 13181

SEQ ID NO: 16780 - protein, 567 aa, Homo Sapiens; identical to SEQ ID NO: 14646

SEQ ID NO: 16781 - protein, 851 aa, Homo Sapiens; identical to SEQ ID NO: 13184

SEQ ID NO: 16782 - protein, 390 aa, Homo Sapiens
MPPSGLRLLLLLLPLLWLLVLTPGRPAAGLSTCKTIDMELVKRKRIEAIRGQILSKLRLASPPSQGEVPPGPLPEAVLALYNSTRDRVAGESAEPEPEPEADYYAKEVTRVLMVETHNEIYDKFKQSTHSIYMFFNTSELREAVPEPVLLSRAELRLLRLKLKVEQHVELYQKYSNNSWRYLSNRLLAPSDSPEWLSFDVTGVVRQWLSRGGEIEGFRLSAHCSCDSRDNTLQVDINGFTTGRRGDLATIHGMNRPFLLLMATPLERAQHLQSSRHRRALDTNYCFSSTEKNCCVRQLYIDFRKDLGWKWIHEPKGYHANFCLGPCPYIWSLDTQYSKVLALYNQHNPGASAAPCCVPQALEPLPIVYYVGRKPKVEQLSNMIVRSCKCS

SEQ ID NO: 16783 - protein, 414 aa, Homo Sapiens; identical to SEQ ID NO: 13160

SEQ ID NO: 16784 - protein, 412 aa, Homo Sapiens; identical to SEQ ID NO: 13162

SEQ ID NO: 16785 - protein, 233 aa, Homo Sapiens; identical to SEQ ID NO: 16534

SEQ ID NO: 16786 - protein, 205 aa, Homo Sapiens; identical to SEQ ID NO: 8093

SEQ ID NO: 16787 - protein, 933 aa, Homo Sapiens; identical to SEQ ID NO: 13682

SEQ ID NO: 16788 - protein, 635 aa, Homo Sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 16789 - protein, 281 aa, Homo Sapiens [sequence omitted]

SEQ ID NO: 16790 - protein, 468 aa, Homo Sapiens; identical to SEQ ID NO: 16514

SEQ ID NO: 16791 - protein, 440 aa, Homo Sapiens; identical to SEQ ID NO: 16515

SEQ ID NO: 16792 - protein, 317 aa, Homo Sapiens; identical to SEQ ID NO: 13609

SEQ ID NO: 16793 - protein, 249 aa, Homo Sapiens; identical to SEQ ID NO: 13611

SEQ ID NO: 16794 - protein, 114 aa, Homo Sapiens; identical to SEQ ID NO: 14356

SEQ ID NO: 16795 - protein, 114 aa, Homo Sapiens; identical to SEQ ID NO: 14357

SEQ ID NO: 16796 - protein, 594 aa, Trichoplusia ni; identical to SEQ ID NO: 14487

SEQ ID NO: 16797 - DNA, 2488 bp, Ctenoplusia agnata
ccctagaagcccaatctacgtcattctgacgtgtatgtcgccgaaaatactctgtctctttctcctgcacgatcggattgccgcgaacgctcgattcaacccagttggcgccgagatctattggaggactgcggcgttgattcggtaagtcccgccattttgtcatagtaacagtattgcacgtcagcttgacgtatatttgggctttgtgttatttttgtaaattttcaacgttagtttattattgcatctttttgttacattactggtttatttgcatgtattactcaaatattatttttattttagcgtagaaaatacaatggcgtctcgtcaacatttataccaggatgaaatagcagcaatactggaaaatgaagatgattattctcctcacgataccgactctgaaatggaagattgtgttacccaagatgatgtcaggagtgacgttgaagacgagatggtggataatattggcaatggtacgagtccagcaagtaggcacgaggatcctgagacccctgacccgtcatcagaagcttctaatcttgaggtaactttatcttcacacagaattattatattacctcagcgttcgattcgtgaaaagaataatcacatttggtctacaacaaaaggtcagtcttctggtaggactgctgctataaatattgtacgtaccaatagaggacctactcgaatgtgtagaaacattgtcgatccattactctgctttcaactttttataaaagaagagattgttgaggaaattgtcaagtggacaaacgtggaaatggtacaaaaacgtgtaaacctgaaggacatctcagcaagttatagggataccaatgaaatggaaatctgggctattataagtatgctcaccttatcggccgttatgaaagacaatcatctgtctactgacgagttgttcaatgtctcctatggcactcgatacgtttcagtaatgagtcgagagagatttgaatttctattgcgattattgagaatgggtgataaattactgagaccaaatttacgccaagaggatgctttcacacctgtgagaaaaatatgggagatttttatcaaccaatgtagactgaattacgtacctggcactaacttgactgtcgatgaacagttgttaggttttcgcggccgttgtcctttccggatgtatattccgaacaaaccggacaaatatggtattaaatttcctatggtatgtgatgctgctacaaagtacatggtagatgctatcccttatctaggcaaaagcactaagacacaaggtctgccattaggcgagttttatgtgaaggagctgactcaaacagtacacggaacaaacagaaatgtcacttgtgacaactggttcacgtctgttccattagctaagagtttgctaaacagtccatataatttaacgctagtgggaaccatcaggtcaaacaagagggagataccagaagaagtcaagaactcacgttcgcggcaggtaggttcgtcaatgttttgttttgatggccctctgacattagtttcctataaacccaagccgtcaaagatggtattcttattatcatcatgtaatgaagatgccgtggtcaatcaaagtaatgggaagccggatatgatattattttacaatcagaccaaaggaggtgttgattcatttgaccagatgtgttcatctatgtcgacaaataggaagactaataggtggcctatggcagtcttttacggcatgttgaatatggcatttgtcaattcctacattatatactgccataacatgttggctaaaaaagaaaaacctctaagtcgcaaagattttatgaaaaaattaagcacagacttgacaacaccgtcgatgcaaaaacgtctggaggctcctactttgaagcggtccttacgtgataacataacaaatgttttaaaaattgtaccacaggcagccatagatacttcatttgatgaaccagagccgaagaaaaggcgctattgtggattttgctcatataaaaaaaagagaatgacaaagacacagtgcttcaagtgcaaaaaaccagtatgtggagagcacaatattgatgtttgtcaagactgcatataaagactgttttttttgtatttgcattatatattatattctaaagttgatttaattctaagaaaaacattaaaataagtttctttttgtaaaatttaattaattataagaaaaagtttaagttgatctcattttttataaaaatttgcaatgtttccaaagttattattgtaaaagaataaataaaagtaaactgagttttaattgatgttttattatatcattatactatatattacttaaataaaacaataactgaatgtatttctaaaaggaatcactagaaaatatagtgatcaaaaatttacacgtcatttttgcgtatgattgggctttataggttctaaaaatatgattgggcctctaggg

SEQ ID NO: 16798 - protein, 591 aa, Anopheles gambiae
MGDAMHVQWLSEETEEVPENEEDMLYEDVEYIEEYVHFPDGPESNVSGSVAVQNEESTGHVIKIESIDHAFDMLQNSVWSIKPPERTGTMGRKVAHPRPAPVGLAKSAKSPAECLSLFLDADVIAMITEYTNEQIKAEQPNYARERDANPTDEMEIMALLGVLYIAGTVRDGRENIERLFDTKMGTGLEAVYLTMTSLRYHFLIRSIRFDDPTAAPDEIEGDKLAPIRPIYERIVSNCQKYLRPGRFLMLDEQAVQFKGKCEFRQILPSAPGRAGFRFHLLVDCETSYVSNLEICVPENQNPYNLSYAPTDVAMRLTEPVQGRQKTVILGAGLTSIDLIEKLYASRTMAMGEVPKSYPDLPKALIANKGRPEHSTLAAYHDPATLVSYVTRRKEVMLLMSSFVDFDSEEQAGEQDEGEQHLKLVELYNRTKTTIRTIQQMCAKHNVVRSTRRWPVAVFFNLMNLSAINAWCIYCLNHPEEAKMSRRDFLVTMALELLRPQARRRLDSKTLPRLLRQRIGLFLGISREEYETVPVVERQGGESRGRCYLCGRARNKTTRISCHSCGKYTCNAHCAQLCRTCYMDDCASEQQE

SEQ ID NO: 16799 - protein, 565 aa, Anopheles gambiae
MADNLNNIPNCFPNNEDSSSDSDHDAKSDESDMENNIEEVMQASIMEELDEDSQEQATGRCVNALEARSSWKPWAGKQKPFPFFRKKRLRVDLPAKSTPYEIFSLILDDKLVAHIALAMNLYMEKKNAQKSKASKWLETNPKEVRKFIGLMIWMDLVRVGRLEDYWSESALYNFAVPRAAMYRERFRALLGAFCFYDDGTSKTDYKEPGKIGAFIDVLQSKFQALLHLGEDVVVREMLALGRDRTSFKQYIPASAHRHGRWALFKLCSLEGYTWGLKLCTEQRLIGEAQLANSVCMELCEPLLNQGRTVYIDNFHASFDLAQALLANQTHLVGTVRVNGSSMPKDVLLAKLRKGEIIARENDDGVMVLKWKGTCTMGLLSTKHSPALVPMESQVRSNRRWIRVARIQPEAVIAHIQAKGRPDRSDAIGPHITDLRKGMKWYKQVGLVLLLQVCVTNAWILHRMVTKKKLKLATFREQLVDQLVPLPNPTVERGLSGGEKKYTHHLEVRTDGNGRTVRRSCANCYAESRKTMSHYEAGRNKKATTTFCGSCPKQPQLCMPCFNKLH

SEQ ID NO: 16800 - protein, 500 aa, Anopheles gambiae
MFPLPSNCDPVFTMAALGPYVVIEPLDSEYVVNDTGPAACAEATPNTDGGGEPEQQSDDDDLICLWEEPQTFGIFDEPVGTNVPFDGADERTASEYAALVCDDALFDILVKGTNRHRKQWADCMRAGGQSVEPYRKVTVAEMKRYVGLLLVMGQVRKDCQHCYWSTNPLLETPVFANTMSYKRFQQISHYFHGMKQANRTYDAKPVLDHLVPKFQALYAPKQQLIVSELTIPQDVLNGQQTEPPNHSEDAQGSTPESAKRLRLLCESDTGYVLNVELANQQLDQVALTDVSIVRPYFGRWHHVYWGNDGITVAAAETLYANQTLACGTLRNDPDGTVAPERKSPVLVMDGQGKRILSTIHGAAAMQPTEGEPQGPPPACVADLNRHLADLERFEGLLVEEYLSNASVGWHIRTVLLLINVALLNAYILFSQTDTGSRFTFNVFRLAVAREWVGASEPLEEPTKFLPLIRGRKRKFLPLIPGRKRKETGLHNRVPKHPARN

SEQ ID NO: 16801 - protein, 577 aa, Aphis gossypii
MTVEQIRSLLQDISTETDCVDDQESDSDLSIEDVEVSDHESNSEQDFSDNESDLETSLGDSTFYIGKDKITKWQLKEFTTSKIRQHNIVNVVPGPKECARNIVSEIDAFLKIIDLDMIDEIVTCTNMYISNMRQRVQYSRPRDCLDTSRCEILAYFGLLFLIGIKKAHHANVKELWSADGSGTEITRATMSYKRFLFLCRCLRFDDRGTRAERRVIDKLSPIRTTFDLFLKNINKNYNLSEYTTIDEMLHPFRGRCQWIQYIPSKPAKYGIKMFALCDAKTFYTSKIEIYVGKQPPGPYEVSNSPIDIVKRLVTPIENSKRNLTTDNWYTSIPLADYLLQKKITLTGTLKKNKREIPTEFLPHKKKEVGSSVFGFQKNKTLVSYVPRKNKAVILLSTMHHDSKIDVETRKPEIIIDYNCTKGGVDTVDKMCAAYSVSRITKRWPLVIFYSLMNIAGINAQVLFSYSKHNNAPKIRRLFLKTLAFDLMKEHLAFRAQISSLPSDISSFLKIKYAVPSTSDVSTTPPSKRGTCFECGRKKNAATSMKCTKCMRFVCKLHSKKIIICEKCSNNDDNGNSE

SEQ ID NO: 16802 - DNA, 2634 bp, Aphis gossypii
ccttccagcgggcgcgctgttgtaaataatacaacagttttatatttattggtttattcaatttttattctatttttatcttatcggcggtcatgggtattcctctataatgttattatctacgttttagactatttttgaagtgtttcagttcattgtattgcagacaatcgacgaagtacttatagtgttgtcacaaaatacaacacgcgccattccgtgtacctacgccaaacacaaaacgcgtgttcggtgtacgcatcgttcgtcgtatctgacttattattttgtaatttttatttttgtgtggtaataaaaacaaaaatatgtaagtattgttttatatcactatgcaatatataatatatacattttaatttttcttacaatatgttttttttattatttgtatacgccaaacacaaaacgcgtgttcggtgtacgcatcgttcgtcgtatctgacttattattttgtaatttttatttttgtgtggtaataaaaacaaaaatatgtaagtattgttttatatcactatgcaatatataatatatacattttaatttttcttacaatatgttttttttattatttgtatacgtttttggtacgtactaataatcgatattatttatacaatgtcttaggtcggatcatatgacagttgaacaaattcgaagtttactgcaagacatttcaactgaaacagattgtgttgatgaccaggagagtgatagtgatctaagtatcgaagatgtggaggtaagtgaccacgaaagcaattctgaacaagatttttcagacaatgaatcagatctagagactagtttgggggacagtacattctacataggaaaagataaaataactaaatggcaactaaaagagtttacaacttcaaaaattaggcaacataatatagtaaacgtagttcctggtccaaaggagtgcgctagaaatattgttagtgagatagatgcatttctaaaaataattgatcttgacatgattgacgaaatcgtaacgtgcactaacatgtatattagtaatatgagacaacgagttcaatactctagaccccgagactgcttagatacttcaaggtgtgaaatactggcttattttggacttttatttttgattggtataaagaaagctcatcatgctaatgtaaaagaattatggtcggcggatggttctggtacagaaataactagggccactatgagctacaaaagatttttgtttttatgtcgctgcctcagatttgacgatcgcggaactagagctgaaagacgggtgattgataaactgtctcctattcgtactacgtttgacctttttttgaaaaatatcaataagaattataatttgagtgaatatactactattgacgaaatgttacacccatttcgtggtcggtgtcaatggatacagtatatcccaagtaaaccggccaaatatggcatcaaaatgtttgcattatgtgatgcaaaaacattttacacgagtaaaatagagatttatgttggaaaacaaccacctggtccgtatgaggtttctaattcaccaattgatatcgtaaaacgattagtaacacccatcgaaaactctaaacgaaatcttaccactgacaactggtataccagtattccacttgcagattacttattacaaaaaaaaattactctaactggaactttgaaaaaaaacaagcgagaaatacctacagaatttttaccacataaaaaaaaagaagttggttcgagcgtgttcgggtttcaaaaaaataaaacgttagtgtcatacgtacctcgaaaaaacaaggcagttattttgctttcaactatgcaccatgattcaaaaattgatgtagaaactcgtaaaccagaaataattatagattataattgtaccaaaggtggagttgatacagtagataaaatgtgcgcggcatattctgtctctagaattacaaaaaggtggccacttgtaattttttattctttgatgaatattgctggaataaatgctcaggtactgttttcatactctaaacataacaatgcccctaaaattagaagattatttttgaaaacattggcatttgatctaatgaaggaacatcttgcttttcgagctcaaatctcaagtttaccatcggacatatcatcttttttgaaaataaaatatgctgttccaagtacatcagatgtatctacaacccccccttcaaaacgaggaacttgcttcgaatgcgggagaaaaaaaaatgcggctacatctatgaagtgcaccaagtgtatgcgatttgtatgtaagctacattcaaaaaaaattattatttgtgaaaagtgttctaataacgatgacaatggcaattctgaataatttcttactgtaaacaaatactaaaaataattttaatttttgatgtaataataataagacgtattgattttttaataaaacataattataatagtatttaaataaaaacaactttgtgaacgtacctattgtttattttattattagatataatatgtacgactatcacagcatattaggactgttgtaaaatttacaacgcgcgactactcttgtttcaaataatggcgcgcccgctggaagg

SEQ ID NO: 16803 - protein, 545 aa, Acyrthosiphon pisum
MISDEDILLHLDEIIANEDEFIDDINFDIENNDIEVTELEVTDPPSPDHSPIVQRNFRPKEHYFDSSKCGVQKHEFGLNSNSSKLEFFKAFVSEFLLGKVAFETNRYAKQYIQSNEISHQSRVNAWKDTNVDEMYTFLATTILMSRNKKLDMKDYWSTDPLLSSPIFRQIISRNRYLLLHQMLHFCNNENQEKGNRLFKLDVVLDEIRTNFKAGMVPFQNIVIDESLVLWKGRLSFKQFIKTKRHRFGIKFFVLCDVETDFILDFIIYTGTETRLLPYDANIGISGAVVKTLIAPYLNKGYNLYTDNWYTSPILAQYLYKKKTTITGTVRKNRRGMPELKNKLAVGDVQSAHSKNIMVLKWVDRREVFMLSTKFDSNLDNSGKFDRKGNLVKKPICVINYNQCMGSIDKTDMLLSSVECVRKTSKCILNAFSAFKTVTGQNMPLANFQLEVIRQLLEKYGGNTVSPRGRPCTKDQPFRLSARHFPSDVKKLASGKVQRRKCIVCTRNNKRKDTMYMCQECDVGLCATPCFAIYHTKQNYLAVQLF

SEQ ID NO: 16804 - DNA, 2476 bp, Agrotis ipsilon
ccctagaagcccaatctacgtaaatttgacgtataccgcggcgaaatatatctgtctctttcacgtttaccgtcggattcccgctaacttcggaaccaactcagtagccattgagaactcccaggacacagttgcgtcatctcggtaagtgccgccattttgttgtaatagacaggttgcacgtcattttgacgtataattgggctttgtgtaacttttgaaattatttataatttttattgatgtgatttatttgagttaatcgtattgtttcgttacatttttcatatgatattaatattttcagattgaatataaaatggagtcccgtcaacggctaaaccaggacgaaatagctacaattttagaaaatgatgacgattattctccactggattcggactccgaggcagaagatcgtgtagttgaagatgatgtctggagtgataacgaggacgcgatgatcgactacgttgaagatacaagcaggcaagaggaccccgataacaatattgcttctcaggaatcggctaatcttgaggtaacttcgttgacttcacaccgaataattagtttgcctcagcggtcaatatgtggaaaaaacaaccatgtatggtcaactacaaagggacgtacgacgggcaggacttctgctatcaatataatacgcacaaataggggaccaacgcgaatgtgtcgcaatattgttgatccattgctttgttttcaactttttataacggatgagataattcatgaaatagttaagtggacaaacgtcgagatgatagtaaaacgtcaaaatttgatagacatttcagcaagctacagggatacaaatacaatggagatgtgggcgttagtcggcattctcactctgacggcagttatgaaagataaccacttatcaactgatgagttgtttgacgctacattctctggcaccagatacgtatcagtaatgagccgagagagattcgaattcctaataagatgtatgagaatggacgacaaaacactgcgaccaactcttcgtagcgatgatgcttttataccggtgagaaaactatgggagatttttatcaatcaatgcagactaaactacgttcctggcggtaacttgactgtagatgagcaattgttgggttttcgcggccgttgtccattccggatgtatattcccaacaaacctgataaatatggcataagattccccatgatgtgtgacgctgccacaaagtacatgatagatgccataccgtaccttggtaaaagtacaaaaacaaatggtttaccactgggcgagttttatgtaaaagagctgactaaaacagtacacggcacaaatagaaatgttacctgcgacaactggttcacgtctatcccattagcgaagaacatgctccaggctccatacaacctaacaatagtaggaaccatcaggtctaacaaaagagaaatacctgaagagatcaagaattctcgatcacggccggtaggatcctcaatgttttgctttgatggccctttgaccttggtttcgtataaaccaaagccgtcaagaatggtatttttattgtcttcctgtgatgaaaatgccgttatcaatgaaagtaacggaaaaccggacatgatattgttttataatcaaacaaaaggcggtgttgattcctttgaccagatgtgtaagtctatgtctgctaacaggaaaactaataggtggccgatggcggtcttttatggcatgttgaatatggcgtttgtgaattcctatataatatactgtcacaataagataaataaacaaaaaaaaccgataaaccgcaaagaatttatgaaaaatttaagtacagatctgacgacaccttggatgcaagaacgactaaaagcacctactttgaagaggactctacgcgacaatataacaaatgttttaaaaaatgtggtaccgccatctccggctaataatagtgaggagccaggaccaaagaaacgaagctattgtggattttgttcatataaaaaaaggcggatgaccaagacgcagttttacaaatgcaaaaaggctatatgtggagaacacaatattgacgtttgtcaagactgtgtataaagactgttttttttaaaaggcttataaagtattactattgcgtgatttaattttataaaaatatttaaaaccagttgatttttttaataattacctaattttaagaaaaaatgttagaagcttgatatttttgttgatttttttctaagatttgattaaaaggccataattgtattaataaagagtatttttaacttcaaatttattttatttattaattaaaacttcaattatgataatacatgcaaaaatatagttcatcaacagaaaaatataggaaaactctaatagttttatttttacacgtcatttttacgtatgattgggctttatagctagtcaaatatgattgggcttctaggg

SEQ ID NO: 16805 - protein, 505 aa, Chilo suppressalis
MIQGQIMVSDTEEEPSDSTGRTKRRRTYAWRKRDLAKNPVNWPDVQGACQDKRPIEWFENFLDEDVISLLVSESNKYAVKKNLPGDITTEDMKCFIGILLVSGYSWLPRRRMYWENSPDTKNELISSAMTRDRFDFIFRHLHVNDNLDLQDKYTKVRPLVTLLNKKFLEFSPLEEHYSVDEAMIPYYDRHGCKQHIKGKPIRYGFKAWVGATRLGYVLWMEPYQGATTMCNPIYKELGLGASVVLTFCDVLISRGFDLPYHVVFDNFFTGTPLLEEITKKGLRCTGTVRENRTSSCPLITSKLLKKKERGAVDYRTTHDNTFIIAKWHDNNIFSIASNAVGINPKQSAKRFSQSEKRNIVIEEPHMVSIYNKYMGGVDRSDENISHYRIGIRGKKWYMPLLTHMIDLAEHNAWQLYKINHGKLDHLGFRRRVAIALIESNRKNAKRGPSRPSHHEHADSRKDQMNHLVIPQSKQTHCRQCHKKCLTRCKKCDVGVCVKCFETYHS

SEQ ID NO: 16806 - DNA, 2406 bp, Chilo suppressalis
cccagattagcctactgtcctatatttaggacagtagaaataaaaaaaaatatcagaataccctctttatctaagattatttagtcttatgatttgcagtaagaaacgtgtcagctttattagaaaaaataaaaagacagttattttaacagtttttaccttataagtgtgtaataaaagtgcgttgcagacatggcaaatgacaggtatgtataaaaagttatattttactcgtgagttgtttttttctgtgttaatatctagttgataaccttaacttttgtactaaataaatattctagcaaaataatataaataaattacgtataacttgttacaaatactagcgtactatatataggacagtaggataatatacatgattttagtacaataatacaactttttctttacagaccgttagctgcgcatgaaattttagatgctttagaaaatgtttctgataatgaagaagattatagagaacgactgatatgtattctacctcctcctgttgatcctgcctgtctcactgacgaagattcgggtgaataagataatgtaactttgaataatttgccacgaaacattctgcttcaaccggctgaagtaatgattcaagggcagattatggtgagtgatacagaagaagaaccttctgattctacaggtcgaactaaacgtaggcgtacctacgcatggagaaaacgggacttggcaaaaaatcccgtgaattggccagatgttcaaggcgcttgccaagataagcgcccaattgagtggtttgaaaacttcttagatgaagatgttatttcgttgttggtgtcagagagcaataaatatgctgtcaaaaagaatttgcctggagacataaccactgaagatatgaaatgtttcatcggcatattgttggttagtggttattcatggctcccccgtagaagaatgtattgggaaaactcccctgatacaaagaatgaattgatcagctcggctatgactagggatagatttgactttatttttcgccaccttcatgtcaatgataatctggatttgcaagacaaatacacaaaagtacgccccctagttacacttctaaataaaaagttcttagagttttctcctcttgaagagcattacagtgtagatgaggccatgatcccctactatgatagacatggctgcaaacagcacataaaaggtaaacctattaggtacgggttcaaagcttgggttggtgctacacggttagggtatgttttatggatggaaccataccaaggtgctacaactatgtgcaatccaatatataaagaattggggctgggtgcaagcgttgttctcactttttgcgatgtgctgatttcacgtggcttcgaccttccttaccacgtagtttttgataatttttttactgggacgcccttgctggaagagataacaaagaaaggccttcgttgcactgggacagttcgagaaaacaggacatctagttgtcctctgattacatcgaagttactgaaaaaaaaggaacgtggtgctgtcgattacagaacgacacatgacaacacgttcattattgctaaatggcatgacaataatatattcagtattgcttctaatgctgtaggaataaatcctaaacaatctgccaaacgcttctcacaaagtgaaaagagaaacattgtcatagaagaaccacatatggtgtccatctataacaaatatatgggaggagtggatcggtctgatgaaaatatttcacattaccgaattggtatacgaggtaagaaatggtacatgccgttgctcacacacatgattgatcttgccgaacataatgcatggcagttatataaaataaatcatggaaaactggatcatcttggctttcgcagaagggtagcaattgctttgattgaatcaaacagaaaaaatgccaaaagagggcctagccgaccctcccatcatgaacatgctgatagtcgtaaagaccaaatgaatcatctggttattcctcaatcgaagcaaacacactgtcgtcaatgtcacaaaaaatgtttgacacgttgcaagaaatgtgatgttggagtgtgtgtcaagtgttttgaaacatatcattcataaatagtgttaatctagtaaattacatataacaatgggtaatataatcaatagttatctaataaactacactttttgattacattctgttttgtcataaatggtcttttatttcctcttattatcctactgtcctacatataggacggctgtttccctgaaagccttacacttaatttttttttcataattttttttatgttgcataagatctaataaactaaataatgtaacttttttgaaaattttcagaaaattttagtttcaggcttatctggg

SEQ ID NO: 16807 - protein, 622 aa, Drosophila melanogaster
MSSSGRKRKQQLKPRQDDHRSPVKRRSVDIKSEPLDGYPALADYDLSTADIKPDLTELQLQLVAEQQAASNTIRLELEQQESDSDEDGYSELDYQAEDVFCQDDMDDYDPDWSSQQTGSRLLFKFPIQQSGLKFGQRFQGPQHYFNQVLGNRSKFFSSLAQSCNLKGGELKSNPTTAEEMEIFMALSLLMCDLKLEHLSDYWSTNMFYGLVGFSGKIPLERYQQLLHCLNFDAPQLQAGRAKVKNSLLLDFINERMEEIYICGQQLVLNEPITLWKGALRYQDELPNKFRTNALLLHMLTEQSGLVVKILPEIVRKEDAPAWVRNSRQLVEHRNKIVLKLMEGYHGGRTVYTSKFYGSYGLAQELAKKSTYCTGLLDRNRYGNSKALVHQRLDSNSISTSYATSLMMAKWRRRAKSLYCFSSDCLAIYSKEMAMQKTNAKPKLIQELEFQLRPGNDGRHHLIHYQAACKELKANIKLTIFLLNILVYNAYLLYFANGQNARVGHLKSYSEFRVIIIKSLLREEVTNEPVTSIQKPETYERSKNKPVPEPRLKTILHEPMLIQQNGKPAKKNCRYCHKGGMLQFSRYMCNTCPDKPGLCQEPCFLLWHEQLKKVIRQTIGRSE

SEQ ID NO: 16808 - protein, 581 aa, Heliotis virescens
MSKMASKRLSNTQIVDVLEDDEECIIDSPDEDEVDAEVIQSDHNSESQESANEIDSEWSDTDNEPLSRLASEDSDNFYFSKNKCTKWAKEPPRTSVRVRRHNIMRETPGPKGRAKEIQTISEAFFCMFSMDTVNLVLQQTNDYIKSIQEKFQRERDCKVLEYEELLAYLGLLYMSGVLRSSHLNFKDLWATDGTGIEFFQNTMSFNRFLFISRCVRFDDKNTKSERLKTDKLAAVREFTDLMNNNFINNYCASENVTLDEQLPAFRGRFSGVVYMPNKPTKYGIKHYALVDSATFYLLKFEIYAGVQPEGPYRMPNDTVSLVKRMTEPIWGTGRNVTMDNWFTSVPLANILLKDHQLTMVGTIRKNKPEIPTCFQPKRTRTEHSSLFGFQEDVTLCSYVPKKSKAVLLISSMHNDNNIVESEKKKPEIILYYNSTKGGVDTNDQMCANYNVGRRTKRWPMVIFYHLLNVAGINAYVIFKNKIDHGISRREFLKHLAVDLVKVHQQTRSNIPQLPRAVQKRLKRNAEVQDPGSTSRGGPSTSYKRCHICPRSKDKKIRFMCAKCHHHICHDHSTMICDKCID

SEQ ID NO: 16809 - protein, 594 aa, Macdunnoughia crassisigna
MGSSINDEHILSALLQSDDELVGEDSDSEISDHVSEDDVQSDTEEAFIDEVHEVQPTSSGSEILDEQNVIEQPGSSLASNRTLTLPQRTIRGKNKHCWSTSKSTRRSRVSALNIVRSQRGPTRMCRNIYDPLLCFKLFFTDEIISEIVKWTNAEISLKRRESMTGATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRMYIPNKPSKYGIKILMMCDSGTKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKNFMRNLYMSLTSSFMRKRLEAPTLKRYLRDNISNILPNEVPGTSDDSTEEPVTKKRTYCTYCPSKIRRKANASCKKCKKVICREHNIDMCQSCF

SEQ ID NO: 16810 - DNA, 2472 bp, Macdunnoughia crassisigna
ccctagaaagatagtctgcgtaaaattgacgcatgcattcttgaaatattgctctctctttctaaatagcgcgaatccgtcgctgtgcgtttaggacatctcagtcgccgcttggagctcccgtgaggcgtgctcgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatcgtgactaatatataataaaatgggtagttctataaacgatgagcatatcctctctgctcttctgcaaagcgatgacgagcttgttggtgaggattctgacagtgaaatatcagatcacgtaagtgaagatgacgtccagagcgatacagaagaagcgtttatagatgaggtacatgaagtgcagccaacgtcaagcggtagtgaaatattagacgaacaaaatgttattgaacaaccaggttcttcattggcttctaacagaaccttgaccttgccacagaggactattagaggtaagaataaacattgttggtcaacttcaaagtccacgaggcgtagccgagtctctgcactgaacattgtcagatctcaaagaggtccgacgcgtatgtgccgcaatatatatgacccacttttatgcttcaaactattttttactgatgagataatttcggaaattgtaaaatggacaaatgctgagatatcattgaaacgtcgggaatctatgacgggtgctacatttcgtgacacgaatgaagatgaaatctatgctttctttggtattctggtaatgacagcagtgagaaaagataaccacatgtccacagatgacctctttgatcgatctttgtcaatggtgtacgtctctgtaatgagtcgtgatcgttttgattttttgatacgatgtcttagaatggatgacaaaagtatacggcccacacttcgagaaaacgatgtatttactcctgttagaaaaatatgggatctctttatccatcagtgcatacaaaattacactccaggggctcatttgaccatagatgaacagttacttggttttagaggacggtgtccgtttaggatgtatatcccaaacaagccaagtaagtatggaataaaaatcctcatgatgtgtgacagtggtacaaagtatatgataaatggaatgccttatttgggaagaggaacacagaccaacggagtaccactcggtgaatactacgtgaaggagttatcaaagcctgtgcacggtagttgtcgtaatattacgtgtgacaattggttcacctcaatccctttggcaaaaaacttactacaagaaccgtataagttaaccattgtgggaaccgtgcgatcaaacaaacgcgagataccggaagtactgaaaaacagtcgctccaggccagtgggaacatcgatgttttgttttgacggaccccttactctcgtctcatataaaccgaagccagctaagatggtatacttattatcatcttgtgatgaggatgcttctatcaacgaaagtaccggtaaaccgcaaatggttatgtattataatcaaactaaaggcggagtggacacgctagaccaaatgtgttctgtgatgacctgcagtaggaagacgaataggtggcctatggcattattgtacggaatgataaacattgcctgcataaattcttttattatatacagccataatgtcagtagcaagggagaaaaggttcaaagtcgcaaaaattttatgagaaacctttacatgagcctgacgtcatcgtttatgcgtaagcgtttagaagctcctactttgaagagatatttgcgcgataatatctctaatattttgccaaatgaagtgcctggtacatcagatgacagtactgaagagccagtaacgaaaaaacgtacttactgtacttactgcccctctaaaataaggcgaaaggcaaatgcatcgtgcaaaaaatgcaaaaaagttatttgtcgagagcataatattgatatgtgccaaagttgtttctgactgactaataagtataatttgtttctattatgtataagttaagctaattacttattttataatacaacatgactgtttttaaagtacaaaataagtttatttttgtaaaagagagaatgtttaaaagttttgttactttatagaagaaattttgagtttttgtttttttttaataaataaataaacataaataaatggtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctaggg

SEQ ID NO: 16811 - DNA, 2464 bp, Pectinophora gossypiella
ccctagataactaaacattcgtccgctcgacgacgcgctatgccgcgaaattgaagtttacctattattccgcgtcccccgcccccgccgctttttctagcttcctgatttgcaaaatagtgcatcgcgtgacacgctcgaggtcacacgacaattaggtcgaaagttacaggaatttcgtcgtccgctcgacgaaagtttagtaattacgtaagtttggcaaaggtaagtgaatgaagtatttttttataattattttttaattctttatagtgataacgtaaggtttatttaaatttattacttttatagttatttagccaattgttataaattccttgttattgctgaaaaatttgcctgttttagtcaaaatttattaacttttcgatcgttttttagatggatttgagaaaacaagatgagaaaatacgtcaatggcttgagcaagatattgaggaggacagtaagggagagtcagacaattcaagttcggaaacggaagatattgtggagatggaagttcacaaaaatacgagcagcgaatctgaagtttccagcgagtccgattacgaacccgtttgcccaagtaagagacagagaacgcaaattattgaatcagaggaatctgataactccgaaagtattcgcccaagcagaagacagacaagtcgggttattgattcggacgaaactgatgaggatgtaatgagctccactcctcagaatatccctcgtaatccgaatgttattcagccaagttccagattcctttatggtaaaaataaacacaaatggtcgtcagcagccaaaccatcttctgtgcgaacttctagaagaaacatcatacattttataccaggaccaaaagaaagagcaagggaagtttctgaaccaattgatatattttccctgtttataagcgaagatatgttgcaacaagtcgtgacatttactaatgcagagatgcttattagaaaaaataagtataaaaccgagacgtttactgtatctcctaccaatttggaagaaataagagctttgcttggtttattgttcaatgcagcagctatgaaaagtaatcatttaccaactcgcatgcttttcaatactcatcgatcaggaacgattttcaaagcttgtatgagcgcagaacgattaaattttcttatcaaatgcctccgatttgatgacaagcttacaagaaatgtaagacagcgagatgataggtttgcacctatacgtgacttgtggcaagcattgatatctaactttcagaaatggtacactccagggtcctatattaccgtagacgaacagctggtcggatttcgaggaagatgttcatttaggatgtatattccaaacaagcctaataaatacggaataaaacttgttatggctgcagatgtaaacagcaaatatatagtgaatgccattccgtacttgggaaaaggaactgatcctcaaaatcaaccgttggctacgttttttataaaagaaataacgtctacattacatggcacgaatcgaaacataaccatggacaactggttcacgtctgttcccttagctaacgagctgttgatggcaccttataatttgacattagtgggaactctaagaagtaataaacgagaaattcctgaaaaactcaaaaattctaagtcacgcgcaattggtacttcgatgttttgttacgatggtgataagacattagtttcatacaaagccaaatctaataaagttgttttcatcttgtctacaattcatgatcaacctgacatcaatcaagaaacaggaaaaccagaaatgattcatttctacaacagtacaaagggtgcagtagataccgtggaccaaatgtgctccagcatttccaccaacagaaaaacccaaagatggcctttgtgcgtgttttataacatgttgaatctatcgattatcaatgcgtacgttgtatacgtttataataatgttagaaataataaaaaacctatgtctcggcgtgacttcgttataaaactaggagaccaacttatggagccctggctgcggcagcggttgcagacggtgactttgagacgtgatatcaaggtcatgatacaagatatcttaggggagtcttctgatctagaagcccctgttccttctgtgtctaatgtgcgtaaaatctactacctatgtccttccaaagcccgaagaatgacaaaacaccgatgcattaaatgcaaacaggctatttgcgggccccataatattgacatatgtagtcgctgtattgaatagtttcactaagtaattttgttcctatttagtagataagtaacacataattattgtgatattcaaaacttaagaggtttaataaataataataaaaaaaaaatggtttttatttcgtagtctgctcgacgaatgtttagttattacgtaaccgtgaatatagtttagtagtctaggg

SEQ ID NO: 16812 - protein, 449 aa, Tribolium castaneum
MDIFRLVDLAAAYDGTATGFEIDVWRPTMNTTNVYPVHAIKMAENDNYVGLSKEEVSALKELITTAESEEDSDIETELENVNDCWSTDPLLHTPIFSKVMPRDRYLLLLRLLHFCDNTKQKKGERTFKIDLVMSFLSNRFKVLFTPFENLCIDESLVLWKERLSFKQYIKSKRHRFGVKMFVLCNVETDYILGFIVYTGSQTKIKPSDLGISGSVVLTLLEDYLDKGHNLYIDNWHSSPELALHLYQHKTNVCGTVRTNRRHMPKLPDPKVKGDIESQHTAEMMTGKVDRTSKEEVKKPTCIVDYNANMGSVDKVDMLLSSVECLRKTIKWYKKIFFHLVDLCMINAHAMYKLEVIRQIVKKYAKIQKTSKKGRPSSGDNPLRLIGRHFPQKIPPVPGGKKTCQRICFVCKHTQRGVSRRRDTSYQCAECDKALCLIPCFEVYHTKQIF

SEQ ID NO: 16813 - protein, 487 aa, Daphnia pulicaria
MQKKADAKKVAQHKAANRNWKECKVWGDVGRQSRADDDSPRPQFQERAIQFAPLEEPGPVLSQFNRFSNPLGVFKSMLGGEDTLYLLREATNDYIAEFWSSRKTPPSRKVGGKPEGRLIGPRLPAGGFVTDHELVAFFGIQFLIGYHRLPELSMFWEQQPDAGLGLGIIQQAMTRERFKFISKHIACASPWDDVDPNSDDPDQEPERPDPIRKIRPLVKRLNERYHACRKPPRGQSIDESMVKFKGRSVLRQTMKNKPIKSGFKIWSRCCHRGYTYKFEIYQGARFGEKQGRSRNNEAVERVVVDLCQPLTDQGFVVAFDRFFTSIALLDKLRENGVNAVGTILPSRVNQPIMTKNESNLRPDEFAAKFGGEPGTCRKGIFVWRDTKAFRVASNYHGSNLVKVRRKQRDGSFKTKSCPKAIDDYVNNMGGVDTANQLRSYYERDRKAKKWWHRLLYSLLETCLVNSWICFNDMVRSQMAEIKTSNTQ

SEQ ID NO: 16814 - protein, 585 aa, Homo Sapiens
MSNPRKRSIPMRDSNTGLEQLLAEDSFDESDFSEIDDSDNFSDSALEADKIRPLSHLESDGKSSTSSDSGRSMKWSARAMIPRQRYDFTGTPGRKVDVSDITDPLQYFELFFTEELVSKITRETNAQAALLASKPPGPKGFSRMDKWKDTDNDELKVFFAVMLLQGIVQKPELEMFWSTRPLLDTPYLRQIMTGERFLLLFRCLHFVNNSSISAGQSKAQISLQKIKPVFDFLVNKFSTVYTPNRNIAVDESLMLFKGPLAMKQYLPTKRVRFGLKLYVLCESQSGYVWNALVHTGPGMNLKDSADGLKSSRIVLTLVNDLLGQGYCVFLDNFNISPMLFRELHQNRTDAVGTARLNRKQIPNDLKKRIAKGTTVARFCGELMALKWCDGKEVTMLSTFHNDTVIEVNNRNGKKTKRPRVIVDYNENMGAVDSADQMLTSYPSERKRHKVWYKKFFHHLLHITVLNSYILFKKDNPEHTMSHINFRLALIERMLEKHHKPGQQHLRGRPCSDDVTPLRLSGRHFPKSIPATSGKQNPTGRCKICCSQYDKDGKKIRKETRYFCAECDVPLCVVPCFEIYHTKKNY

SEQ ID NO: 16815 - protein, 409 aa, Mus musculus
MPPSASAVDFFQLFVPDNVLKNMVVQTNMYARKFQERFGSDGAWVEVTLAEMKAFLGYVISTSVSHCESVLSIWSGGFYSNRSLALVMSQARFEKILKYFHVVAFRSSQTTHGLYKVQPFLDSLQSGFDAAFRPSQTQVLHEPLIDEDPVFIATCTERELRKRKKRKFSLWVRQCSSTGFIIQIYVHLKEGGGPDGLDALKNKPQLHSMVARSLCRNAAGKNYIIFTGPSITSLNLFEEFEKQGIYCCGLLSSRKSDCTGLPPSMLTNPATPLARGQHQIRTKGNMSLICWYNKGHFRFLTNAYSPVQKGVIIKRRSGEIPCPLAVEAFAAHLSYICRYDDKYSKYFISHKPNKTWQQVFWFAISIAVNNAYILYKMSDAYHVKKYSRAQFGERLVRELLGLEDSSPAH

SEQ ID NO: 16816 - protein, 704 aa, Macaca fascicularis
MRPEAEGDSEGEESEYFPTEEEEEEEEDDEVEGVEADLSGDGTDYELKPLPKGRKRQKKVPVQEIDDDFFPSSGEEAEASPIGEGGGGGRKVGRYRDDGDEDYYKQRLSPKMPRTLSLHEITDLLETDDSIEASAIVIQPPENATAPVSDEESGDEEGGTINNLPGSLLHTAAYLIQDGSDAESDSDDPSYAPKDDSPDEVPSTSSVQQPPPSRRRKMTKIVCKWKKADLTVQPVAGRVTAPPNDFFTEMRTPTEILELFLDDEVIELIVKYSNLYADSKGVHLGLTSSEFKCFLGIIFLSGYVSVPRRRMFWEQRTDVHNVLVSAAMRRDRFETIFSNLHVADNADLDPVDKFSKLRPLISKLNERCMKFVPNETYFSFDEFMVHYFGRHGCKQFIRGKPIRFGYKFWCGATCLGYICWFQPYQGKNPNTKHEEYGVGASLVLQFSEALTEAHPGRYHFVSNNFFTSIALLDKLSSMGHQATGTVRKDHIDKVPLESDVALKKKERGTFDYRIDGKGNIVCRWNDNSVVTVASSGAGIHPLCLVSRYSQKLKKKIQVQQPNMIKVYNQFMGGVDRADENIDKYRASIRGKKWYSSPLLFCFELVLQNAWQLHKTYDEKPVDFLEFRRRVVCHYLETHGHPPEPGQKGRPQKRNIDSRYDGINHVIVKQGKQTRCAECHKNTAFRCEKCDVALHVKCSVEYHTE

SEQ ID NO: 16817 - DNA, 2511 bp, Macaca fascicularis
ttggcagatcaagcaaaactgtcttttgaaaggaaggagcaagctacttgtaataaaagaccagctagaaaagctccagcctcagtcacgcctccggccccaacacaaagtaaaaacaaaccaaacaagaaagccaaagttctgtccaaaaaagaggagcgtttgaaaaagcacatcaagaaactccagaagagggctttgcagttccaggggaaagtgggattgccaaaggcaaggagaccctgggagtcagacatgaggccagaggcagagggagactctgagggtgaagagtctgagtatttccccacagaggaggaggaggaggaggaggaagatgacgaggtggagggggtggaggcagacctctctggagacggtactgactatgagctgaagcctctgcccaagggccggaaacggcagaagaaagtcccagtgcaggagattgacgacgactttttcccaagttctggggaagaagctgaagcttctcctataggagaaggaggaggaggaggtcggaaagtaggaagataccgagatgatggagatgaagattattataagcagcggttaagtcccaagatgcctcgaacactaagtttacatgaaataactgaccttttagagacagatgacagcatagaagcaagtgctatagtgatacaaccacctgaaaatgctacagcacctgtttcagatgaggaatcaggagatgaagaaggtggaacaataaataatctgccaggttctttgttgcacacagctgcgtatcttattcaagatggctctgatgctgagtctgactcagatgatccctcatatgcacctaaagatgactctcctgatgaagttccatctacgtcttctgtgcagcaacctccaccatcaaggaggaggaaaatgacaaaaattgtttgcaaatggaaaaaagccgacctaactgtacaacccgtagcaggtagagttacagcaccaccaaacgatttcttcaccgaaatgagaactcccacagaaattcttgaactttttcttgatgacgaggtcattgaactcattgtcaagtactccaacttatatgctgacagtaaaggtgtacatcttggcttgactagctctgaattcaaatgttttctgggaattatttttctgagtggttatgtttcagttcctagaaggcgtatgttttgggaacaaagaacggatgtgcataatgtactggttagtgctgccatgagacgtgaccgatttgaaactatattttctaatttgcatgttgctgacaatgcagatttggatccagtggacaaattttccaaattgcgacctctcataagcaaactcaatgagagatgcatgaaatttgttccaaatgaaacatatttcagctttgatgaattcatggttcattattttggtcgtcatgggtgcaaacagtttattcggggaaagcccattcggtttggctataagttttggtgtggtgccacctgtctgggctacatttgctggtttcagccgtatcagggtaaaaacccaaatactaaacatgaggaatatggtgtcggtgcgtcacttgtccttcagtttagtgaggcacttacagaggcacaccctggacgataccattttgtatccaataactttttcaccagtattgcacttcttgataagctcagttcaatgggacatcaggcaacaggtacagtgagaaaggatcacattgacaaagttccattggaatcagatgtagctttaaagaaaaaagaaagaggcacatttgattatcgaattgatggcaaaggcaatattgtctgcagatggaatgataacagtgttgtcactgttgcctcatctggtgctggtatccatcccctgtgtcttgtcagtcgttattcccagaaattgaaaaagaagatccaagttcagcagccaaacatgatcaaagtgtataaccaattcatgggaggcgtagacagagctgatgaaaacattgataagtatcgggcctcaatccgtggaaagaaatggtattcaagccctcttttgttctgtttcgaattggtcttacaaaatgcttggcaattgcataaaacatatgatgagaaaccagtggattttctggagtttcgtcgacgtgtggtatgccattatctggagacccatggtcatcctccagaacctggccaaaaaggaagacctcagaagcgtaacattgactcccgttatgatggcataaatcatgtgatagtcaaacagggaaagcaaacgcggtgcgctgaatgtcataagaacaccgcttttcgatgtgaaaaatgtgatgttgccttacatgtgaagtgttccgttgaatatcacactgaatagcaggtgtcaccacctcctgagacaagaaacataattttatacattatgtacagtggttttgcctagtgttccaattttggaacgtcacataacaatggaacataataaattttttttatcttcaaaaaaaaaaaaaaaaaa

SEQ ID NO: 16818 - protein, 591 aa, Rattus norvegicus
  misc_feature (382)..(382): Xaa can be any naturally occurring amino acid
MSHTDLHGRWFVLCDESVDAVSYACPMRFLLVSESQCPFEGDDPARGGAHSKVRSPKLLKVLSALEEGESGSNREEIFIAPPNNASEDLTDEDSGEEDSDQNSAQLPGWVLRASVLFIVNETNRYARQKNITLDLTVQELKRDRFELIFSYLHFVDNSEPDESDSFAKGTLFTKDRGLDVGASMVVRFVDALQECGCLPCHIFLDKVFTSVKPMSILREKGVKATGTVCEYRTECCPLKDAKELRKMRKGSFDYRVDESQEIIVCRWSNSHVVNICSNAVGIEPARGVGRMDQNIAKYKVKIRGMKRYLSFIGYIIDAALNNAWQLHRVCCQDGHVDLHSFRSYVARVYLESNVDTSSPGRRSRWVETENRFNMIGHWIVHXDKRTQCALCHSQTNTCCEKCQKGVHTFSSYSDITRNTFRWPVRRDRDVGKETFTQAWGGGAGKTQSQLLSKVDDIKQSLDIIHTQRAPESLKIRDPVTRGRDCIEQRGLRMQVLVSHRQHSRVPSRRELEEAVALGLALSLTLMCAQQNEDPSNKIKQQKKTERKHRHVVATSIHILEPGQKAVSSVPETGPMIVSDLPCVATNVQTPR

SEQ ID NO: 16819 - protein, 581 aa, Ciona intestinalis
MAVKGVSADETIWSFLEAESEKDKGDAAYACSSDESDILMDEFNATSSKNVDAPNHCCLSSDDETTVHTSSKLQKLLNDRSKSKRTVQQTHLEELSAEDSMEDWVRIVTDYYPEDHNLRETVMESGMDGVTPLDYLAMFLSAEFWDLLVTETNRHAAQTLRKKKLKKGSNLRTWKDTTVAEMKAYFAILLSMGLCNTVDMQDYWSASWITVTSSISKIMSRVRFTLIRAMLHFCNDEESSSKNSQKHNRLFKVRQLIDVLVPKFSALYKPDKELAIHEMTVACNYKSEQRVRKKPIQWTDKVYALTEARTGYLLEWAIHAGSSRETEKGASIVRKLCTRYIGKHDIYINTANSYTNRNLAKEFVSQTNGSGGIPGELKTINEKNNPVCAKSAVRSSEIKAKSATQKGNKRSYNDMKKANSKKRYNYLSGVIPIFRQLNLFRHKTVKWSLRIFENLAQICVVNSYILYTSKTSDSSDKMDLKKYIEACVSGLLVDYNPHITEKWRPPQPGTVLSRILPPQYVHKIIKIDKKPQCVVCSDSRRKLGRRQTSFMCEKCNVALCVVPCFHRYHTLKNYRVCHLDM

SEQ ID NO: 16820 - protein, 589 aa, Artificial Sequence
  Synthetic Sequence
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 16821 - DNA, 56 bp, Artificial Sequence
  Synthetic Sequence
taatacgactcactatagctggtacacggcagggtcagttttagagctagaaatag

SEQ ID NO: 16822 - DNA, 37 bp, Artificial Sequence
  Synthetic Sequence
taatacgactcactatagagaatcaaaatcggtgaat

SEQ ID NO: 16823 - DNA, 36 bp, Artificial Sequence
  Synthetic Sequence
taatacgactcactatagtgctagacatgaggtcta

SEQ ID NO: 16824 - DNA, 38 bp, Artificial Sequence
  Synthetic Sequence
taatacgactcactataggctggtacacggcagggtca

SEQ ID NO: 16825 - DNA, 56 bp, Artificial Sequence
  Synthetic Sequence
taatacgactcactatagagaatcaaaatcggtgaatgttttagagctagaaatag

SEQ ID NO: 16826 - DNA, 55 bp, Artificial Sequence
  Synthetic Sequence
taatacgactcactataggatttagagtctctcagcgttttagagctagaaatag

SEQ ID NO: 16827 - DNA, 55 bp, Artificial Sequence
  Synthetic Sequence
taatacgactcactatagtgctagacatgaggtctagttttagagctagaaatag

SEQ ID NO: 16828 - DNA, 56 bp, Artificial Sequence
  Synthetic Sequence
taatacgactcactatagacaccttcttccccagcccgttttagagctagaaatag

SEQ ID NO: 16829 - DNA, 57 bp, Artificial Sequence
  Synthetic Sequence
taatacgactcactatagtggaataatgctgttgttgagttttagagctagaaatag

SEQ ID NO: 16830 - DNA, 57 bp, Artificial Sequence
  Synthetic Sequence
taatacgactcactatagcatcacaggaactttctaaagttttagagctagaaatag

SEQ ID NO: 16831 - DNA, 56 bp, Artificial Sequence
  Synthetic Sequence
taatacgactcactatagtaaaaccaagaggccacaggttttagagctagaaatag

SEQ ID NO: 16832 - DNA, 57 bp, Artificial Sequence
  Synthetic Sequence
taatacgactcactatagacccggccactttcaggagggttttagagctagaaatag

SEQ ID NO: 16833 - DNA, 56 bp, Artificial Sequence
  Synthetic Sequence
taatacgactcactatagattaaacccggccactttcgttttagagctagaaatag

SEQ ID NO: 16834 - DNA, 57 bp, Artificial Sequence
  Synthetic Sequence
taatacgactcactatagagcccaggtaagggcagcttgttttagagctagaaatag

SEQ ID NO: 16835 - DNA, 57 bp, Artificial Sequence
  Synthetic Sequence
taatacgactcactatagagctttgaaacaggtaagacgttttagagctagaaatag

SEQ ID NO: 16836 - DNA, 56 bp, Artificial Sequence
  Synthetic Sequence
taatacgactcactatagctttgaaacaggtaagacagttttagagctagaaatag

SEQ ID NO: 16837 - DNA, 57 bp, Artificial Sequence
  Synthetic Sequence
taatacgactcactatagtttcaaaacctgtcagtgatgttttagagctagaaatag

SEQ ID NO: 16838 - DNA, 57 bp, Artificial Sequence
  Synthetic Sequence
taatacgactcactatagctgcggctgtggtccagctggttttagagctagaaatag

SEQ ID NO: 16839 - DNA, 56 bp, Artificial Sequence
  Synthetic Sequence
taatacgactcactatagctgtggtccagctgaggtggttttagagctagaaatag

SEQ ID NO: 16840 - DNA, 57 bp, Artificial Sequence
  Synthetic Sequence
taatacgactcactatagctgtggtccagctgaggtgagttttagagctagaaatag

SEQ ID NO: 16841 - DNA, 57 bp, Artificial Sequence
  Synthetic Sequence
taatacgactcactatagtgtggtccagctgaggtgaggttttagagctagaaatag

SEQ ID NO: 16842 - DNA, 57 bp, Artificial Sequence; identical to SEQ ID NO: 16841
  Synthetic Sequence

SEQ ID NO: 16843 - DNA, 56 bp, Artificial Sequence
  Synthetic Sequence
taatacgactcactataggctgctccttgaggggctggttttagagctagaaatag

SEQ ID NO: 16844 - DNA, 56 bp, Artificial Sequence
  Synthetic Sequence
taatacgactcactataggcagtatctggagtcattggttttagagctagaaatag

SEQ ID NO: 16845 - DNA, 37 bp, Artificial Sequence
  Synthetic Sequence
taatacgactcactataggcctcggcgctgacgatct

SEQ ID NO: 16846 - DNA, 37 bp, Artificial Sequence
  Synthetic Sequence
taatacgactcactataggctctcggagaatgacgag

SEQ ID NO: 16847 - DNA, 56 bp, Artificial Sequence
  Synthetic Sequence
taatacgactcactataggcctcggcgctgacgatctgttttagagctagaaatag

SEQ ID NO: 16848 - DNA, 56 bp, Artificial Sequence
  Synthetic Sequence
taatacgactcactataggagaatgacgagtggacccgttttagagctagaaatag

SEQ ID NO: 16849 - DNA, 56 bp, Artificial Sequence
  Synthetic Sequence
taatacgactcactataggctctcggagaatgacgaggttttagagctagaaatag

SEQ ID NO: 16850 - DNA, 57 bp, Artificial Sequence
  Synthetic Sequence
taatacgactcactatagcaaacacagcgacctcgggtgttttagagctagaaatag

SEQ ID NO: 16851 - DNA, 57 bp, Artificial Sequence
  Synthetic Sequence
taatacgactcactatagtggctcaaacacagcgacctgttttagagctagaaatag

SEQ ID NO: 16852 - DNA, 57 bp, Artificial Sequence
  Synthetic Sequence
taatacgactcactatagagggcgggctgctccttgaggttttagagctagaaatag

SEQ ID NO: 16853 - DNA, 56 bp, Artificial Sequence
  Synthetic Sequence
taatacgactcactatagtatctggagtcattgaggggttttagagctagaaatag

SEQ ID NO: 16854 - DNA, 57 bp, Artificial Sequence
  Synthetic Sequence
taatacgactcactatagactggacttgacagcggaaggttttagagctagaaatag

SEQ ID NO: 16855 - DNA, 57 bp, Artificial Sequence
  Synthetic Sequence
taatacgactcactatagagagatctcccacacccaaagttttagagctagaaatag

SEQ ID NO: 16856 - DNA, 57 bp, Artificial Sequence
  Synthetic Sequence
taatacgactcactatagccacacccaaaaggccacacgttttagagctagaaatag

SEQ ID NO: 16857 - DNA, 57 bp, Artificial Sequence
  Synthetic Sequence
taatacgactcactatagactgcctgagcagccgcctggttttagagctagaaatag

SEQ ID NO: 16858 - DNA, 57 bp, Artificial Sequence
  Synthetic Sequence
taatacgactcactatagtgagggtctcggccaccttcgttttagagctagaaatag

SEQ ID NO: 16859 - DNA, 57 bp, Artificial Sequence
  Synthetic Sequence
taatacgactcactatagatgacgagtggacccaggatgttttagagctagaaatag

SEQ ID NO: 16860 - DNA, 57 bp, Artificial Sequence; identical to SEQ ID NO: 16851
  Synthetic Sequence

SEQ ID NO: 16861 - DNA, 57 bp, Artificial Sequence; identical to SEQ ID NO: 16856
  Synthetic Sequence

SEQ ID NO: 16862 - DNA, 57 bp, Artificial Sequence
  Synthetic Sequence
taatacgactcactatagagacaggtgacggtccctgcgttttagagctagaaatag

SEQ ID NO: 16863 - DNA, 56 bp, Artificial Sequence
  Synthetic Sequence
taatacgactcactatagcagtgccaggttagagagagttttagagctagaaatag

SEQ ID NO: 16864 - DNA, 56 bp, Artificial Sequence
  Synthetic Sequence
taatacgactcactatagaagttgacttactgaagaagttttagagctagaaatag

SEQ ID NO: 16865 - DNA, 57 bp, Artificial Sequence
  Synthetic Sequence
taatacgactcactatagacccagacacatagcaattcgttttagagctagaaatag

SEQ ID NO: 16866 - DNA, 57 bp, Artificial Sequence
  Synthetic Sequence
taatacgactcactatagtcacgtcatccagcagagaagttttagagctagaaatag

SEQ ID NO: 16867 - DNA, 56 bp, Artificial Sequence
  Synthetic Sequence
taatacgactcactatagatattcctcaggtactccagttttagagctagaaatag

SEQ ID NO: 16868 - DNA, 56 bp, Artificial Sequence
  Synthetic Sequence
taatacgactcactataggccacggagcgagacatctgttttagagctagaaatag

SEQ ID NO: 16869 - DNA, 57 bp, Artificial Sequence
  Synthetic Sequence
taatacgactcactatagactctctctttctggcctgggttttagagctagaaatag

SEQ ID NO: 16870 - DNA, 55 bp, Artificial Sequence
  Synthetic Sequence
taatacgactcactataggagagagaattgaaaaaggttttagagctagaaatag

SEQ ID NO: 16871 - DNA, 20 bp, Artificial Sequence
  Synthetic Sequence
catcgctgttaagaagctcc

SEQ ID NO: 16872 - DNA, 20 bp, Artificial Sequence
  Synthetic Sequence
ggccctccagctgggagtcc

SEQ ID NO: 16873 - DNA, 20 bp, Artificial Sequence
  Synthetic Sequence
gggtctgctgggtctggatg

SEQ ID NO: 16874 - DNA, 20 bp, Artificial Sequence
  Synthetic Sequence
gttctgaggcaggggtctgc

SEQ ID NO: 16875 - DNA, 20 bp, Artificial Sequence
  Synthetic Sequence
cccgccccaacgctgccccc

SEQ ID NO: 16876 - DNA, 20 bp, Artificial Sequence
  Synthetic Sequence
ccttcgcacaggtacctaac

SEQ ID NO: 16877 - DNA, 20 bp, Artificial Sequence
  Synthetic Sequence
gtcttggggctcttagcatc

SEQ ID NO: 16878 - DNA, 20 bp, Artificial Sequence
  Synthetic Sequence
acggccttgctgtggggaag

SEQ ID NO: 16879 - DNA, 20 bp, Artificial Sequence
  Synthetic Sequence
tctgatgatcttgccaaagt

SEQ ID NO: 16880 - DNA, 20 bp, Artificial Sequence
  Synthetic Sequence
ctaccacttctatgaccaga

SEQ ID NO: 16881 - DNA, 20 bp, Artificial Sequence
  Synthetic Sequence
cagtaagtttgtggtgggtg

SEQ ID NO: 16882 - DNA, 20 bp, Artificial Sequence
  Synthetic Sequence
ggaccctgaagaccccggag

SEQ ID NO: 16883 - DNA, 20 bp, Artificial Sequence
  Synthetic Sequence
cccggagaggaggctgcaga

SEQ ID NO: 16884 - DNA, 20 bp, Artificial Sequence
  Synthetic Sequence
ctgtgcgaaggggccgggga

SEQ ID NO: 16885 - DNA, 20 bp, Artificial Sequence
  Synthetic Sequence
agaggaggctggggaggacg

SEQ ID NO: 16886 - DNA, 20 bp, Artificial Sequence
  Synthetic Sequence
cccaggtggtgctgaggctg

SEQ ID NO: 16887 - DNA, 20 bp, Artificial Sequence
  Synthetic Sequence
gggatcctggtaagtgtgtt

SEQ ID NO: 16888 - DNA, 20 bp, Artificial Sequence
  Synthetic Sequence
atcaaagctcgaaggcttgg

SEQ ID NO: 16889 - DNA, 20 bp, Artificial Sequence
  Synthetic Sequence
gcagtgccaggttagagaga

SEQ ID NO: 16890 - DNA, 20 bp, Artificial Sequence
  Synthetic Sequence
caagccagcgacgcagtgcc

SEQ ID NO: 16891 - DNA, 20 bp, Artificial Sequence
  Synthetic Sequence
ccaatcaggacaaggcccgc

SEQ ID NO: 16892 - DNA, 20 bp, Artificial Sequence
  Synthetic Sequence
acccagacacatagcaattc

SEQ ID NO: 16893 - DNA, 20 bp, Artificial Sequence
  Synthetic Sequence
gatattcctcaggtactcca

SEQ ID NO: 16894 - DNA, 20 bp, Artificial Sequence
  Synthetic Sequence
ggccacggagcgagacatct

SEQ ID NO: 16895 - DNA, 20 bp, Artificial Sequence
  Synthetic Sequence
catcgctgttaagaagctcc

SEQ ID NO: 16896 - DNA, 20 bp, Artificial Sequence
  Synthetic Sequence
ggtccatctggtcatagaag

SEQ ID NO: 16897 - DNA, 20 bp, Artificial Sequence
  Synthetic Sequence
ggccctccagctgggagtcc

SEQ ID NO: 16898 - DNA, 20 bp, Artificial Sequence
  Synthetic Sequence
ccttgctcaggccctccagc

SEQ ID NO: 16899 - DNA, 20 bp, Artificial Sequence
  Synthetic Sequence
gggtctgctgggtctggatg

SEQ ID NO: 16900 - DNA, 20 bp, Artificial Sequence
  Synthetic Sequence
gttctgaggcaggggtctgc

SEQ ID NO: 16901 - DNA, 20 bp, Artificial Sequence
  Synthetic Sequence
tgagagtggtggagtgcttc

SEQ ID NO: 16902 - DNA, 20 bp, Artificial Sequence
  Synthetic Sequence
ctcgttccctcgctgccggt

SEQ ID NO: 16903 - DNA, 20 bp, Artificial Sequence
  Synthetic Sequence
cccgccccaacgctgccccc

SEQ ID NO: 16904 - DNA, 20 bp, Artificial Sequence
  Synthetic Sequence
ccttcgcacaggtacctaac

SEQ ID NO: 16905 - DNA, 20 bp, Artificial Sequence
  Synthetic Sequence
cagccggggctagggccgcg

SEQ ID NO: 16906 - DNA, 20 bp, Artificial Sequence
  Synthetic Sequence
gccgcggccgccaccgaggc

SEQ ID NO: 16907 - DNA, 20 bp, Artificial Sequence
  Synthetic Sequence
gccgcgctctcgcctccccc

SEQ ID NO: 16908 - DNA, 20 bp, Artificial Sequence
  Synthetic Sequence
gtcttggggctcttagcatc

SEQ ID NO: 16909 - DNA, 20 bp, Artificial Sequence
  Synthetic Sequence
acggccttgctgtggggaag

SEQ ID NO: 16910 - DNA, 20 bp, Artificial Sequence
  Synthetic Sequence
tctgatgatcttgccaaagt

SEQ ID NO: 16911 - DNA, 20 bp, Artificial Sequence
  Synthetic Sequence
gtcttggggctcttagcatc

SEQ ID NO: 16912 - DNA, 20 bp, Artificial Sequence
  Synthetic Sequence
aggctcatcttctgccatcc

SEQ ID NO: 16913 - DNA, 20 bp, Artificial Sequence
  Synthetic Sequence
agacaggtgacggtccctgc

SEQ ID NO: 16914 - DNA, 20 bp, Artificial Sequence
  Synthetic Sequence
cctgcgggccttgtcctgat

SEQ ID NO: 16915 - DNA, 20 bp, Artificial Sequence
  Synthetic Sequence
tataagtggaggcgtcgcgc

SEQ ID NO: 16916 - DNA, 20 bp, Artificial Sequence
  Synthetic Sequence
gaagttgacttactgaagaa

SEQ ID NO: 16917 - DNA, 20 bp, Artificial Sequence
  Synthetic Sequence
tcacgtcatccagcagagaa

SEQ ID NO: 16918 - DNA, 20 bp, Artificial Sequence
  Synthetic Sequence
actctctctttctggcctgg

SEQ ID NO: 16919 - DNA, 20 bp, Artificial Sequence
  Synthetic Sequence
ctaccacttctatgaccaga

SEQ ID NO: 16920 - DNA, 20 bp, Artificial Sequence
  Synthetic Sequence
agattgagctctactcaggt

SEQ ID NO: 16921 - DNA, 20 bp, Artificial Sequence
  Synthetic Sequence
cagtaagtttgtggtgggtg

SEQ ID NO: 16922 - DNA, 20 bp, Artificial Sequence
  Synthetic Sequence
tgtggtgggtggggaggtct

SEQ ID NO: 16923 - DNA, 20 bp, Artificial Sequence
  Synthetic Sequence
ggaccctgaagaccccggag

SEQ ID NO: 16924 - DNA, 20 bp, Artificial Sequence
  Synthetic Sequence
cccggagaggaggctgcaga

SEQ ID NO: 16925 - DNA, 20 bp, Artificial Sequence
  Synthetic Sequence
gaacgaggtgtcagctctgc

SEQ ID NO: 16926 - DNA, 20 bp, Artificial Sequence
  Synthetic Sequence
ggccaccctagactgtgagt

SEQ ID NO: 16927 - DNA, 20 bp, Artificial Sequence
  Synthetic Sequence
ctgtgcgaaggggccgggga

SEQ ID NO: 16928 - DNA, 20 bp, Artificial Sequence
  Synthetic Sequence
agaggaggctggggaggacg

SEQ ID NO: 16929 - DNA, 20 bp, Artificial Sequence
  Synthetic Sequence
cttggcgccagcctcggtgg

SEQ ID NO: 16930 - DNA, 20 bp, Artificial Sequence
  Synthetic Sequence
ctagtgatgcaaccctgtgc

SEQ ID NO: 16931 - DNA, 20 bp, Artificial Sequence
  Synthetic Sequence
gaggacgaggagactcactc

SEQ ID NO: 16932 - DNA, 20 bp, Artificial Sequence
  Synthetic Sequence
cccaggtggtgctgaggctg

SEQ ID NO: 16933 - DNA, 20 bp, Artificial Sequence
  Synthetic Sequence
gggatcctggtaagtgtgtt

SEQ ID NO: 16934 - DNA, 20 bp, Artificial Sequence
  Synthetic Sequence
atcaaagctcgaaggcttgg

SEQ ID NO: 16935 - DNA, 20 bp, Artificial Sequence
  Synthetic Sequence
ccccaggtggtgctgaggct

SEQ ID NO: 16936 - DNA, 20 bp, Artificial Sequence
  Synthetic Sequence
actgggggaagggccccccc

SEQ ID NO: 16937 - DNA, 19 bp, Artificial Sequence
  Synthetic Sequence
ggagagagaattgaaaaag

SEQ ID NO: 16938 - DNA, 19 bp, Artificial Sequence
  Synthetic Sequence
gggccttgtcctgattggc

SEQ ID NO: 16939 - DNA, 18 bp, Artificial Sequence
  Synthetic Sequence
ggcactgcgtcgctggct

SEQ ID NO: 16940 - DNA, 20 bp, Artificial Sequence
  Synthetic Sequence
ggtccatctggtcatagaag

SEQ ID NO: 16941 - DNA, 19 bp, Artificial Sequence
  Synthetic Sequence
ggagtcctggaagacatac

SEQ ID NO: 16942 - DNA, 19 bp, Artificial Sequence
  Synthetic Sequence
ggtccccaagttctgaggc

SEQ ID NO: 16943 - DNA, 19 bp, Artificial Sequence
  Synthetic Sequence
ggcaggggtctgctgggtc

SEQ ID NO: 16944 - DNA, 19 bp, Artificial Sequence
  Synthetic Sequence
ggcccccgggggcagcgtt

SEQ ID NO: 16945 - DNA, 19 bp, Artificial Sequence
  Synthetic Sequence
ggtacctgtgcgaaggggc

SEQ ID NO: 16946 - DNA, 18 bp, Artificial Sequence
  Synthetic Sequence
gggaagggcccccccagg

SEQ ID NO: 16947 - DNA, 19 bp, Artificial Sequence
  Synthetic Sequence
gccttcgagctttgatgtc

SEQ ID NO: 16948-16971 - skipped (24 entries)

SEQ ID NO: 16972 - protein, 500 aa, Artificial Sequence
  Synthetic Sequence
MSRSVALAVLALLSLSGLEAVMAPRTLILGGGGSGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGGGGSGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 16973 - DNA, 1503 bp, Artificial Sequence
  Synthetic Sequence
atgtctcgcagcgtggccctggccgtgctggccctgctgtccctgtctggcctggaggccgtgatggccccccggaccctgatcctgggaggaggaggcagcggcggaggaggctccggaggcggcggctctatccagcgcacacctaagatccaggtgtattctcggcacccagccgagaacggcaagagcaacttcctgaattgctacgtgagcggctttcacccttccgacatcgaggtggatctgctgaagaatggcgagagaatcgagaaggtggagcactccgacctgagcttctccaaggattggtctttttatctgctgtactataccgagtttacccctacagagaaggacgagtacgcctgtcgcgtgaaccacgtgacactgtcccagccaaagatcgtgaagtgggaccgggatatgggcggcggcggctctggcggcggcggcagcggcggcggcggctccggaggaggcggctctggcagccactccctgaagtatttccacacctctgtgagccggccaggcagaggagagccacggttcatctctgtgggctacgtggacgatacacagttcgtgaggtttgacaatgatgccgccagcccaagaatggtgcctagggccccatggatggagcaggagggcagcgagtattgggacagggagacccggagcgccagagacacagcacagattttccgggtgaacctgagaaccctgaggggctactataatcagtccgaggccggctctcacacactccagtggatgcacggatgcgagctgggaccagatggccgcttcctgcggggctacgagcagtttgcctatgacggcaaggattacctgaccctgaacgaggacctgagatcctggaccgccgtggatacagccgcccagatcagcgagcagaagtccaatgacgcatctgaggcagagcaccagagggcatatctggaggatacctgcgtggagtggctgcacaagtacctggagaagggcaaggagacactgctgcacctggagccccctaagacccacgtgacacaccacccaatcagcgaccacgaggccaccctgaggtgttgggcactgggcttctatcccgccgagatcaccctgacatggcagcaggacggagagggacacacccaggatacagagctggtggagaccaggcccgccggcgatggcacatttcagaagtgggccgccgtggtggtgccttccggagaggagcagagatacacctgtcacgtgcagcacgagggactgccagagccagtgaccctgaggtggaagcctgccagccagcccacaatccctatcgtgggaatcatcgcaggcctggtgctgctgggctctgtggtgagcggagcagtggtggccgccgtgatctggcggaagaagagcagcggaggcaagggaggctcctactccaaggcagagtggagcgactccgcccagggctctgagagccactccctgtga

SEQ ID NO: 16974 - protein, 500 aa, Artificial Sequence
  Synthetic Sequence
MSRSVALAVLALLSLSGLEAVMAPRTLILGGGGSGGGGSGGGGSIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGGGGSGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDRRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 16975 - DNA, 1503 bp, Artificial Sequence
  Synthetic Sequence
atgtctcgcagcgtggccctggccgtgctggccctgctgtccctgtctggcctggaggccgtgatggccccccggaccctgatcctgggaggaggaggcagcggcggaggaggctccggaggcggcggctctatccagcgcacacctaagatccaggtgtattctcggcacccagccgagaacggcaagagcaacttcctgaattgctacgtgagcggctttcacccttccgacatcgaggtggatctgctgaagaatggcgagagaatcgagaaggtggagcactccgacctgagcttctccaaggattggtctttttatctgctgtactataccgagtttacccctacagagaaggacgagtacgcctgtcgcgtgaaccacgtgacactgtcccagccaaagatcgtgaagtgggaccgggatatgggcggcggcggctctggcggcggcggcagcggcggcggcggctccggaggaggcggctctggcagccactccctgaagtatttccacacctctgtgagccggccaggcagaggagagccacggttcatctctgtgggctacgtggacgatacacagttcgtgaggtttgacaatgatgccgccagcccaagaatggtgcctagggccccatggatggagcaggagggcagcgagtattgggacagggagacccggagcgccagagacacagcacagattttccgggtgaacctgagaaccctgaggggctactataatcagtccgaggccggctctcacacactccagtggatgcacggatgcgagctgggaccagatcgccgcttcctgcggggctacgagcagtttgcctatgacggcaaggattacctgaccctgaacgaggacctgagatcctggaccgccgtggatacagccgcccagatcagcgagcagaagtccaatgacgcatctgaggcagagcaccagagggcatatctggaggatacctgcgtggagtggctgcacaagtacctggagaagggcaaggagacactgctgcacctggagccccctaagacccacgtgacacaccacccaatcagcgaccacgaggccaccctgaggtgttgggcactgggcttctatcccgccgagatcaccctgacatggcagcaggacggagagggacacacccaggatacagagctggtggagaccaggcccgccggcgatggcacatttcagaagtgggccgccgtggtggtgccttccggagaggagcagagatacacctgtcacgtgcagcacgagggactgccagagccagtgaccctgaggtggaagcctgccagccagcccacaatccctatcgtgggaatcatcgcaggcctggtgctgctgggctctgtggtgagcggagcagtggtggccgccgtgatctggcggaagaagagcagcggaggcaagggaggctcctactccaaggcagagtggagcgactccgcccagggctctgagagccactccctgtga

SEQ ID NO: 16976 - protein, 476 aa, Artificial Sequence
  Synthetic Sequence
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDMGGGGSGGGGSGGGGSGGGGSGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDRRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 16977 - DNA, 1435 bp, Artificial Sequence
  Synthetic Sequence
atgagcagatctgtggccctggctgttctggctctgctgtctctgtctggcctggaagccatccagcggacccctaagatccaggtgtacagcagacaccccgccgagaacggcaagagcaacttcctgaactgctacgtgtccggctttcaccccagcgacattgaggtggacctgctgaagaacggcgagcggatcgagaaggtggaacacagcgatctgagcttcagcaaggactggtccttctacctgctgtactacaccgagttcacccctaccgagaaggacgagtacgcctgcagagtgaaccacgtgacactgagccagcctaagatcgtgaagtgggacagagatatgggcggaggcggatctggtggcggaggaagtggcggcggaggatctggcggtggtggttctggatctcacagcctgaagtactttcacacctccgtgtccagacctggcagaggcgagcctagattcatcagcgtgggctacgtggacgacacccagttcgtcagattcgacaacgacgccgcctctcctcggatggttcctagagcaccctggatggaacaagagggcagcgagtactgggatcgcgagacaagaagcgccagagacacagcccagatcttccgcgtgaacctgagaaccctgcggggctactacaatcagtctgaggccggctctcacaccctgcagtggatgcatggatgtgaactgggccccgacagacggttcctgagaggctatgagcagttcgcctacgacggcaaggactacctgacactgaacgaggacctgagaagctggaccgccgtggatacagccgctcagatcagcgagcagaagtctaacgacgccagcgaggccgaacaccagagagcctatctggaagatacctgcgtggaatggctgcacaagtacctggaaaagggcaaagagacactgctgcacctggaacctccaaagacacatgtgacccaccatcctatcagcgaccacgaggccacactgagatgttgggccctgggcttttaccctgccgagatcacactgacatggcagcaggatggcgagggccacacacaggatacagagctggtggaaacaagacctgccggcgacggcaccttccagaaatgggctgctgtggttgtgcccagcggcgaggaacagagatacacctgtcacgtgcagcacgagggactgcctgaacctgtgactctgagatggaagcctgccagccagccaacaatccccatcgtgggaatcattgccggcctggtgctgctgggatctgtggtttctggtgctgtggtggccgccgtgatttggagaaagaagtcctctggcggcaaaggcggctcctactctaaggccgagtggagcgattctgcccagggctctgaaagccacagcctgtagataa

SEQ ID NO: 16978 - protein, 419 aa, Artificial Sequence
  Synthetic Sequence
DLLKNGERIEKVEHSDLSFSKDWSFYLLYYTEFTPTEKDEYACRVNHVTLSQPKIVKWDRDMGGGGSGGGGSGGGGSGGGGSGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 16979 - DNA, 1435 bp, Artificial Sequence
  Synthetic Sequence
atgagcagatctgtggccctggctgttctggctctgctgtctctgtctggcctggaagccatccagcggacccctaagatccaggtgtacagcagacaccccgccgagaacggcaagagcaacttcctgaactgctacgtgtccggctttcaccccagcgacattgaggtggacctgctgaagaacggcgagcggatcgagaaggtggaacacagcgatctgagcttcagcaaggactggtccttctacctgctgtactacaccgagttcacccctaccgagaaggacgagtacgcctgcagagtgaaccacgtgacactgagccagcctaagatcgtgaagtgggacagagatatgggcggaggcggatctggtggcggaggaagtggcggcggaggatctggcggtggtggttctggatctcacagcctgaagtactttcacacctccgtgtccagacctggcagaggcgagcctagattcatcagcgtgggctacgtggacgacacccagttcgtcagattcgacaacgacgccgcctctcctcggatggttcctagagcaccctggatggaacaagagggcagcgagtactgggatcgcgagacaagaagcgccagagacacagcccagatcttccgcgtgaacctgagaaccctgcggggctactacaatcagtctgaggccggctctcacaccctgcagtggatgcatggatgtgaactgggccccgacagacagttcctgagaggctatgagcagttcgcctacgacggcaaggactacctgacactgaacgaggacctgagaagctggaccgccgtggatacagccgctcagatcagcgagcagaagtctaacgacgccagcgaggccgaacaccagagagcctatctggaagatacctgcgtggaatggctgcacaagtacctggaaaagggcaaagagacactgctgcacctggaacctccaaagacacatgtgacccaccatcctatcagcgaccacgaggccacactgagatgttgggccctgggcttttaccctgccgagatcacactgacatggcagcaggatggcgagggccacacacaggatacagagctggtggaaacaagacctgccggcgacggcaccttccagaaatgggctgctgtggttgtgcccagcggcgaggaacagagatacacctgtcacgtgcagcacgagggactgcctgaacctgtgactctgagatggaagcctgccagccagccaacaatccccatcgtgggaatcattgccggcctggtgctgctgggatctgtggtttctggtgctgtggtggccgccgtgatttggagaaagaagtcctctggcggcaaaggcggctcctactctaaggccgagtggagcgattctgcccagggctctgaaagccacagcctgtagataa

SEQ ID NO: 16980 - protein, 357 aa, Artificial Sequence
  Synthetic Sequence
MSRSVALAVLALLSLSGLEAGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDRRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 16981 - DNA, 1078 bp, Artificial Sequence
  Synthetic Sequence
atgagcagatctgtggccctggctgttctggctctgctgtctctgtctggactggaagccggcagccacagcctgaagtactttcacaccagcgtgtccagacctggcagaggcgagcctagattcatcagcgtgggctacgtggacgacacccagttcgtcagattcgacaacgacgccgcctctcctcggatggttcctagagcaccctggatggaacaagagggcagcgagtactgggacagagagacaagaagcgccagagacacagcccagatcttcagagtgaacctgcggaccctgcggggctactacaatcagtctgaagccggctctcacaccctgcagtggatgcacggatgtgaactgggccccgacagaagattcctgagaggctacgagcagttcgcctacgacggcaaggactacctgacactgaacgaggacctgagaagctggaccgccgtggatacagccgctcagatcagcgagcagaagtctaacgacgcctctgaggccgaacaccagagagcctacctggaagatacctgcgtggaatggctgcacaagtacctggaaaagggcaaagagacactgctgcacctggaacctccaaagacacacgtgacccaccatcctatcagcgaccacgaggccacactgagatgttgggccctgggcttttaccccgccgagatcacactgacatggcagcaggatggcgagggccacacacaggatacagagctggtggaaacaagacctgccggcgacggcaccttccagaaatgggctgctgtggtggttcccagcggcgaggaacagagatacacctgtcacgtgcagcacgagggactgcctgaacctgtgacactgaggtggaagcctgccagccagcctacaatccccatcgtgggaatcattgccggcctggtgctgctgggatctgtggtttctggtgcagtggtggccgccgtgatctggcggaaaaaaagctcaggcggcaaaggcggctcctactccaaagccgagtggagcgattctgcccagggctctgaaagccactctctgtagataa

SEQ ID NO: 16982 - protein, 357 aa, Artificial Sequence
  Synthetic Sequence
MSRSVALAVLALLSLSGLEAGSHSLKYFHTSVSRPGRGEPRFISVGYVDDTQFVRFDNDAASPRMVPRAPWMEQEGSEYWDRETRSARDTAQIFRVNLRTLRGYYNQSEAGSHTLQWMHGCELGPDGRFLRGYEQFAYDGKDYLTLNEDLRSWTAVDTAAQISEQKSNDASEAEHQRAYLEDTCVEWLHKYLEKGKETLLHLEPPKTHVTHHPISDHEATLRCWALGFYPAEITLTWQQDGEGHTQDTELVETRPAGDGTFQKWAAVVVPSGEEQRYTCHVQHEGLPEPVTLRWKPASQPTIPIVGIIAGLVLLGSVVSGAVVAAVIWRKKSSGGKGGSYSKAEWSDSAQGSESHSL

SEQ ID NO: 16983 - DNA, 1078 bp, Artificial Sequence
  Synthetic Sequence
atgagcagatctgtggccctggctgttctggctctgctgtctctgtctggactggaagccggcagccacagcctgaagtactttcacaccagcgtgtccagacctggcagaggcgagcctagattcatcagcgtgggctacgtggacgacacccagttcgtcagattcgacaacgacgccgcctctcctcggatggttcctagagcaccctggatggaacaagagggcagcgagtactgggacagagagacaagaagcgccagagacacagcccagatcttcagagtgaacctgcggaccctgcggggctactacaatcagtctgaagccggctctcacaccctgcagtggatgcacggatgtgaactgggccccgacggaagattcctgagaggctacgagcagttcgcctacgacggcaaggactacctgacactgaacgaggacctgagaagctggaccgccgtggatacagccgctcagatcagcgagcagaagtctaacgacgcctctgaggccgaacaccagagagcctacctggaagatacctgcgtggaatggctgcacaagtacctggaaaagggcaaagagacactgctgcacctggaacctccaaagacacacgtgacccaccatcctatcagcgaccacgaggccacactgagatgttgggccctgggcttttaccccgccgagatcacactgacatggcagcaggatggcgagggccacacacaggatacagagctggtggaaacaagacctgccggcgacggcaccttccagaaatgggctgctgtggtggttcccagcggcgaggaacagagatacacctgtcacgtgcagcacgagggactgcctgaacctgtgacactgaggtggaagcctgccagccagcctacaatccccatcgtgggaatcattgccggcctggtgctgctgggatctgtggtttctggtgcagtggtggccgccgtgatctggcggaaaaaaagctcaggcggcaaaggcggctcctactccaaagccgagtggagcgattctgcccagggctctgaaagccactctctgtagataa

SEQ ID NO: 16984-17005 - skipped (22 entries)

SEQ ID NO: 17006 - DNA, 5296 bp, Artificial Sequence
  Synthetic Sequence
tcctatataataaaagagaaacatgcaaattgaccatccctccgctacgctcaagccacgcccaccagccaatcagaagtgactatgcaaattaacccaacaaagatggcagttaaatttgcatacgcaggtgtcaagcgccccaggaggcaacggcggccgcgggctcccaggaccttcgctggccccgggaggcgaggccggccgcgcctagccacacccgcgggctcccgggaccttcgccagcagagagcagagcgggagagcgggcggagagcgggaggtttggaggacttggcagagcaggaggccgctggacatagagcagagcgagagagagggtggcttggagggcgtggctccctctgtcaccccagcttcctcatcacagctgtggaaactgacagcagggaggaggaagtcccacccccacagaatcagccagaatcagccgttggtcagacagctctcagcggcctgacagccaggactctcattcacctgcatctcagaccgtgacagtagagaggtgggactatgtctaaagaacaactgttgatacaacgtagctctgcagccgaaagatgccggcgttatcgacagaaaatgtctgcagagcaacgtgcgtctgatcttgaaagaaggcggcgcctgcaacagaatgtatctgaagagcagctactggaaaaacgtcgctctgaagccgaaaaacagcggcgtcatcgacagaaaatgtctaaagaccaacgtgcctttgaagttgaaagaaggcggtggcgacgacagaatatgtctagagaacagtcatcaacaagtactaccaataccggtaggaactgccttctcagcaaaaatggagtacatgaggatgcaattctcgaacatagttgtggtggaatgactgttcgatgtgaattttgcctatcactaaatttctctgatgaaaaaccatccgatgggaaatttactcgatgttgtagcaaagggaaagtctgtccaaatgatatacattttccagattacccggcatatttaaaaagattaatgacaaacgaagattctgacagtaaaaatttcatggaaaatattcgttccataaatagttcttttgcttttgcttccatgggtgcaaatattgcatcgccatcaggatatgggccatactgttttagaatacacggacaagtttatcaccgtactggaactttacatccttcggatggtgtttctcggaagtttgctcaactctatattttggatacagccgaagctacaagtaaaagattagcaatgccagaaaaccagggctgctcagaaagactcatgatcaacatcaacaacctcatgcatgaaataaatgaattaacaaaatcgtacaagatgctacatgaggtagaaaaggaagcccaatctgaagcagcagcaaaaggtattgctcccacagaagtaacaatggcgattaaatacgatcgtaacagtgacccaggtagatataattctccccgtgtaaccgaggttgctgtcatattcagaaacgaagatggagaacctccttttgaaagggacttgctcattcattgtaaaccagatcccaataatccaaatgccactaaaatgaaacaaatcagtatcctgtttcctacattagatgcaatgacatatcctattctttttccacatggtgaaaaaggctggggaacagatattgcattaagactcagagacaacagtgtaatcgacaataatactagacaaaatgtaaggacacgagtcacacaaatgcagtattatggatttcatctctctgtgcgggacacgttcaatcctattttaaatgcaggaaaattaactcaacagtttattgtggattcatattcaaaaatggaggccaatcggataaatttcatcaaagcaaaccaatctaagttgagagttgaaaaatatagtggtttgatggattatctcaaatctagatctgaaaatgacaatgtgccgattggtaaaatgataatacttccatcatcttttgagggtagtcccagaaatatgcagcagcgatatcaggatgctatggcaattgtaacgaagtatggcaagcccgatttattcataaccatgacatgcaaccccaaatgggcagatattacaaacaatttacaacgctggcaaaaagttgaaaacagacctgacttggtagccagagtttttaatattaagctgaatgctcttttaaatgatatatgtaaattccatttatttggcaaagtaatagctaaaattcatgtcattgaatttcagaaacgcggactgcctcacgctcacatattattgatattagatagtgagtccaaattacgttcagaagatgacattgaccgtatagttaaggcagaaattccagatgaagaccagtgtcctcgactttttcaaattgtaaaatcaaatatggtacatggaccatgtggaatacaaaatccaaatagtccatgtatggaaaatggaaaatgttcaaagggatatccaaaagaatttcaaaatgcgaccattggaaatattgatggatatcccaaatacaaacgaagatctggtagcaccatgtctattggaaataaagttgtcgataacacttggattgtcccttataacccgtatttgtgccttaaatataactgtcatataaatgttgaagtctgtgcatcaattaaaagtgtcaaatatttatttaaatacatctataaagggcacgattgtgcaaatattcaaatttctgaaaaaaatattatcaatcatgacgaagtacaggacttcattgactccaggtatgtgagcgctcctgaggctgtttggagactttttgcaatgcgaatgcatgaccaatctcatgcaatcacaagattagctattcatttgccaaatgatcagaatttgtattttcataccgatgattttgctgaagttttagatagggctaaaaggcataactcgactttgatggcttggttcttattgaatagagaagattctgatgcacgtaattattattattgggagattccacagcattatgtgtttaataattctttgtggacaaaacgccgaaagggtgggaataaagtattaggtagactgttcactgtgagctttagagaaccagaacgatattaccttagacttttgcttctgcatgtaaaaggtgcgataagttttgaggatctgcgaactgtaggaggtgtaacttatgatacatttcatgaagctgctaaacaccgaggattattacttgatgacactatctggaaagatacgattgacgatgcaatcatccttaatatgcccaaacaactacggcaactttttgcatatatatgtgtgtttggatgtccttctgctgcagacaaattatgggatgagaataaatctcattttattgaagatttctgttggaaattacaccgaagagaaggtgcctgtgtgaactgtgaaatgcatgcccttaacgaaattcaggaggtattcacattgcatggaatgaaatgttcacatttcaaacttccggactatcctttattaatgaatgcaaatacatgtgatcaattgtacgagcaacaacaggcagaggttttgataaattctctgaatgatgaacagttggcagcctttcagactataacttcagccatcgaagatcaaactgtacaccccaaatgctttttcttggatggtccaggtggtagtggaaaaacatatctgtataaagttttaacacattatattagaggtcgtggtggtactgttttacccacagcatctacaggaattgctgcaaatttacttcttggtggaagaacctttcattcccaatataaattaccaattccattaaatgaaacttcaatttctagactcgatataaagagtgaagttgctaaaaccattaaaaaggcccaacttctcattattgatgaatgcaccatggcatccagtcatgctataaacgccatagatagattactaagagaaattatgaatttgaatgttgcatttggtgggaaagttctccttctcggaggggattttcgacaatgtctcagtattgtaccacatgctatgcgatcggccatagtacaaacgagtttaaagtactgtaatgtttggggatgtttcagaaagttgtctcttaaaacaaatatgagatcagaggattctgcttatagtgaatggttagtaaaacttggagatggcaaacttgatagcagttttcatttaggaatggatattattgaaatcccccatgaaatgatttgtaacggatctattattgaagctacctttggaaatagtatatctatagataatattaaaaatatatctaaacgtgcaattctttgtccaaaaaatgagcatgttcaaaaattaaatgaagaaattttggatatacttgatggagattttcacacatatttgagtgatgattccattgattcaacagatgatgctgaaaaggaaaattttcccatcgaatttcttaatagtattactccttcgggaatgccgtgtcataaattaaaattgaaagtgggtgcaatcatcatgctattgagaaatcttaatagtaaatggggtctttgtaatggtactagatttattatcaaaagattacgacctaacattatcgaagctgaagtattaacaggatctgcagagggagaggttgttctgattccaagaattgatttgtccccatctgacactggcctcccatttaaattaattcgaagacagtttcccgtgatgccagcatttgcgatgactattaataaatcacaaggacaaactctagacagagtaggaatattcctacctgaacccgttttcgcacatggtcagttatatgttgctttctctcgagttcgaagagcatgtgacgttaaagttaaagttgtaaatacttcatcacaagggaaattagtcaagcactctgaaagtgtttttactcttaatgtggtatacagggagatattagaataagtttaatcactttatcagtcattgtttgcatcaatgttgtttttatatcatgtttttgttgtttttatatcatgtctttgttgttgttatatcatgttgttattgtttatttattaataaatttatgtattattttcatatacattttactcatttcctttcatctctcacacttctattatagagaaagggcaaatagcaatattaaaatatttcctctaattaattccctttcaatgtgcacgaatttcgtgcaccgggccactag

SEQ ID NO: 17007 - DNA, 4682 bp, Artificial Sequence
  Synthetic Sequence
cagaggtgtaaagtacttgagtaattttacttgattactgtacttaagtattatttttggggatttttactttacttgagtacaattaaaaatcaatacttttacttttacttaattacatttttttagaaaaaaaagtactttttactccttacaattttatttacagtcaaaaagtacttattttttggagatcacttcattctattttcccttgctattaccaaaccaattgaattgcgctgatgcccagtttaatttaaatgttatttattctgcctatgaaaatcgttttcacattatatgaaattggtcagacatgttcattggtcctttggaagtgacgtcatgtcacatctattaccacaatgcacagcaccttgacctggaaattagggaaattataacagtcaatcagtggaagaaaatggaggaagtatgtgattcatcagcagctgcgagcagcacagtccaaaatcagccacaggatcaagagcacccgtggccgtatcttcgcgaattcttttctttaagtggtgtaaataaagattcattcaagatgaaatgtgtcctctgtctcccgcttaataaagaaatatcggccttcaaaagttcgccatcaaacctaaggaagcatattgaggtaagtacattaagtattttgttttactgatagtttttttttttttttttttttttttttttgggtgtgcatgttttgacgttgatggcgcgccttttatatgtgtagtaggcctattttcactaatgcatgcgattgacaatataaggctcacgtaataaaatgctaaaatgcatttgtaattggtaacgttaggtccacgggaaatttggcgcctattgcagctttgaataatcattatcattccgtgctctcattgtgtttgaattcatgcaaaacacaagaaaaccaagcgagaaatttttttccaaacatgttgtattgtcaaaacggtaacactttacaatgaggttgattagttcatgtattaactaacattaaataaccatgagcaatacatttgttactgtatctgttaatctttgttaacgttagttaatagaaatacagatgttcattgtttgttcatgttagttcacagtgcattaactaatgttaacaagatataaagtattagtaaatgttgaaattaacatgtatacgtgcagttcattattagttcatgttaactaatgtagttaactaacgaaccttattgtaaaagtgttaccatcaaaactaatgtaatgaaatcaattcaccctgtcatgtcagccttacagtcctgtgtttttgtcaatataatcagaaataaaattaatgtttgattgtcactaaatgctactgtatttctaaaatcaacaagtatttaacattataaagtgtgcaattggctgcaaatgtcagttttattaaagggttagttcacccaaaaatgaaaataatgtcattaatgactcgccctcatgtcgttccaagcccgtaagacctccgttcatcttcagaacacagtttaagatattttagatttagtccgagagctttctgtgcctccattgagaatgtatgtacggtatactgtccatgtccagaaaggtaataaaaacatcaaagtagtccatgtgacatcagtgggttagttagaattttttgaagcatcgaatacattttggtccaaaaataacaaaacctacgactttattcggcattgtattctcttccgggtctgttgtcaatccgcgttcacgacttcgcagtgacgctacaatgctgaataaagtcgtaggttttgttatttttggaccaaaatgtattttcgatgcttcaaataattctacctaacccactgatgtcacatggactactttgatgtttttattacctttctggacatggacagtataccgtacatacattttcagtggagggacagaaagctctcggactaaatctaaaatatcttaaactgtgttccgaagatgaacggaggtgttacgggcttggaacgacatgagggtgagtcattaatgacatcttttcatttttgggtgaactaaccctttaatgctgtaatcagagagtgtatgtgtaattgttacatttattgcatacaatataaatatttatttgttgtttttacagagaatgcacccaaattacctcaaaaactactctaaattgacagcacagaagagaaagatcgggacctccacccatgcttccagcagtaagcaactgaaagttgactcagttttcccagtcaaacatgtgtctccagtcactgtgaacaaagctatattaaggtacatcattcaaggacttcatcctttcagcactgttgatctgccatcatttaaagagctgattagtacactgcagcctggcatttctgtcattacaaggcctactttacgctccaagatagctgaagctgctctgatcatgaaacagaaagtgactgctgccatgagtgaagttgaatggattgcaaccacaacggattgttggactgcacgtagaaagtcattcattggtgtaactgctcactggatcaaccctggaagtcttgaaagacattccgctgcacttgcctgcaaaagattaatgggctctcatacttttgaggtactggccagtgccatgaatgatatccactcagagtatgaaatacgtgacaaggttgtttgcacaaccacagacagtggttccaactttatgaaggctttcagagtttttggtgtggaaaacaatgatatcgagactgaggcaagaaggtgtgaaagtgatgacactgattctgaaggctgtggtgagggaagtgatggtgtggaattccaagatgcctcacgagtcctggaccaagacgatggcttcgaattccagctaccaaaacatcaaaagtgtgcctgtcacttacttaacctagtctcaagcgttgatgcccaaaaagctctctcaaatgaacactacaagaaactctacagatctgtctttggcaaatgccaagctttatggaataaaagcagccgatcggctctagcagctgaagctgttgaatcagaaagccggcttcagcttttaaggccaaaccaaacgcggtggaattcaacttttatggctgttgacagaattcttcaaatttgcaaagaagcaggagaaggcgcacttcggaatatatgcacctctcttgaggttccaatgtaagtgtttttcccctctatcgatgtaaacaaatgtgggttgtttttgtttaatactctttgattatgctgatttctcctgtaggtttaatccagcagaaatgctgttcttgacagagtgggccaacacaatgcgtccagttgcaaaagtactcgacatcttgcaagcggaaacgaatacacagctggggtggctgctgcctagtgtccatcagttaagcttgaaacttcagcgactccaccattctctcaggtactgtgacccacttgtggatgccctacaacaaggaatccaaacacgattcaagcatatgtttgaagatcctgagatcatagcagctgccatccttctccctaaatttcggacctcttggacaaatgatgaaaccatcataaaacgaggtaaatgaatgcaagcaacatacacttgacgaattctaatctgggcaacctttgagccataccaaaattattcttttatttatttatttttgcactttttaggaatgttatatcccatctttggctgtgatctcaatatgaatattgatgtaaagtattcttgcagcaggttgtagttatccctcagtgtttcttgaaaccaaactcatatgtatcatatgtggtttggaaatgcagttagattttatgctaaaataagggatttgcatgattttagatgtagatgactgcacgtaaatgtagttaatgacaaaatccataaaatttgttcccagtcagaagcccctcaaccaaacttttctttgtgtctgctcactgtgcttgtaggcatggactacatcagagtgcatctggagcctttggaccacaagaaggaattggccaacagttcatctgatgatgaagattttttcgcttctttgaaaccgacaacacatgaagccagcaaagagttggatggatatctggcctgtgtttcagacaccagggagtctctgctcacgtttcctgctatttgcagcctctctatcaagactaatacacctcttcccgcatcggctgcctgtgagaggcttttcagcactgcaggattgcttttcagccccaaaagagctaggcttgacactaacaattttgagaatcagcttctactgaagttaaatctgaggttttacaactttgagtagcgtgtactggcattagattgtctgtcttatagtttgataattaaatacaaacagttctaaagcaggataaaaccttgtatgcatttcatttaatgttttttgagattaaaagcttaaacaagaatctctagttttctttcttgcttttacttttacttccttaatactcaagtacaattttaatggagtacttttttacttttactcaagtaagattctagccagatacttttacttttaattgagtaaaattttccctaagtacttgtactttcacttgagtaaaatttttgagtactttttacacctctg

SEQ ID NO: 17008-17011 - skipped (4 entries)

SEQ ID NO: 17012 - protein, 187 aa, Artificial Sequence
  Synthetic Sequence
MVGSLNCIVAVSQNMGIGKNGDFPWPPLRNESRYFQRMTTTSSVEGKQNLVIMGKKTWFSIPEKNRPLKGRINLVLSRELKEPPQGAHFLSRSLDDALKLTEQPELANKVDMVWIVGGSSVYKEAMNHPGHLKLFVTRIMQDFESDTFFPEIDLEKYKLLPEYPGVLSDVQEEKGIKYKFEVYEKND

SEQ ID NO: 17013 - protein, 1591 aa, Artificial Sequence
  Synthetic Sequence
MAPKKKRKVEGIKSNISLLKDELRGQISHISHEYLSLIDLAFDSKQNRLFEMKVLELLVNEYGFKGRHLGGSRKPDGIVYSTTLEDNFGIIVDTKAYSEGYSLPISQADEMERYVRENSNRDEEVNPNKWWENFSEEVKKYYFVFISGSFKGKFEEQLRRLSMTTGVNGSAVNVVNLLLGAEKIRSGEMTIEELERAMFNNSEFILKYGGGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKVSS

SEQ ID NO: 17014 - DNA, 4776 bp, Artificial Sequence
  Synthetic Sequence
atggcaccaaagaagaaaagaaaagtggagggcatcaagtcaaacatcagcctgctgaaagacgaactgcggggacagattagtcacatcagtcacgagtacctgtcactgattgatctggccttcgacagcaagcagaatagactgtttgagatgaaagtgctggaactgctggtcaacgagtatggcttcaagggcagacatctgggcgggtctaggaaacctgacggcatcgtgtacagtaccacactggaagacaacttcggaatcattgtcgataccaaggcttattccgagggctactctctgccaattagtcaggcagatgagatggaaaggtacgtgcgcgaaaactcaaatagggacgaggaagtcaaccccaataagtggtgggagaatttcagcgaggaagtgaagaaatactacttcgtctttatctcaggcagcttcaaagggaagtttgaggaacagctgcggagactgtccatgactaccggggtgaacggatctgctgtcaacgtggtcaatctgctgctgggcgcagaaaagatcaggtccggggagatgacaattgaggaactggaacgcgccatgttcaacaattctgagtttatcctgaagtatggaggcgggggaagcgataagaaatactccatcggactggccattggcaccaattccgtgggctgggctgtcatcacagacgagtacaaggtgccaagcaagaagttcaaggtcctggggaacaccgatcgccacagtatcaagaaaaatctgattggagccctgctgttcgactcaggcgagactgctgaagcaacccgactgaagcggactgctaggcgccgatatacccggagaaaaaatcggatctgctacctgcaggaaattttcagcaacgagatggccaaggtggacgatagtttctttcaccgcctggaggaatcattcctggtggaggaagataagaaacacgagcggcatcccatctttggcaacattgtggacgaagtcgcttatcacgagaagtaccctactatctatcatctgaggaagaaactggtggactccaccgataaggcagacctgcgcctgatctatctggccctggctcacatgatcaagttccgggggcattttctgatcgagggagatctgaaccctgacaattctgatgtggacaagctgttcatccagctggtccagacatacaatcagctgtttgaggaaaacccaattaatgcctcaggcgtggacgcaaaggccatcctgagcgccagactgtccaaatctaggcgcctggaaaacctgatcgctcagctgccaggagagaagaaaaacggcctgtttgggaatctgattgcactgtccctgggcctgacacccaacttcaagtctaattttgatctggccgaggacgctaagctgcagctgtccaaagacacttatgacgatgacctggataacctgctggctcagatcggcgatcagtacgcagacctgttcctggccgctaagaatctgagtgacgccatcctgctgtcagatattctgcgcgtgaacacagagattactaaggccccactgagtgcttcaatgatcaaaagatatgacgagcaccatcaggatctgaccctgctgaaggctctggtgaggcagcagctgcccgagaaatacaaggaaatcttctttgatcagagcaagaatggatacgccggctatattgacggcggggcttcccaggaggagttctacaagttcatcaagcccattctggaaaagatggacggcaccgaggaactgctggtgaagctgaatcgggaggacctgctgagaaaacagaggacatttgataacggaagcatccctcaccagattcatctgggcgaactgcacgccatcctgcgacggcaggaggacttctacccatttctgaaggataaccgcgagaaaatcgaaaagatcctgaccttcagaatcccctactatgtggggcctctggcacggggaaatagtagatttgcctggatgacaagaaagtcagaggaaactatcaccccctggaacttcgaggaagtggtcgataaaggcgctagcgcacagtccttcattgaaaggatgacaaattttgacaagaacctgccaaatgagaaggtgctgcccaaacacagcctgctgtacgaatatttcacagtgtataacgagctgactaaagtgaagtacgtcaccgaagggatgcgcaagcccgcattcctgtccggagagcagaagaaagccatcgtggacctgctgtttaagacaaatcggaaagtgactgtcaaacagctgaaggaagactatttcaagaaaattgagtgtttcgattcagtggaaatcagcggcgtcgaggacaggtttaacgcctccctggggacctaccacgatctgctgaagatcatcaaggataaggacttcctggacaacgaggaaaatgaggacatcctggaggacattgtgctgacactgactctgtttgaggatcgcgaaatgatcgaggaacgactgaagacttatgcccatctgttcgatgacaaagtgatgaagcagctgaaaagaaggcgctacaccggatggggacgcctgagccgaaaactgatcaatgggattagagacaagcagagcggaaaaactatcctggactttctgaagtccgatggcttcgccaacaggaacttcatgcagctgattcacgatgactctctgaccttcaaggaggacatccagaaagcacaggtgtctggccagggggacagtctgcacgagcatatcgcaaacctggccggcagccccgccatcaagaaagggattctgcagaccgtgaaggtggtggacgaactggtcaaggtcatgggacgacacaaacctgagaacatcgtgattgagatggcccgcgaaaatcagacaactcagaagggccagaaaaacagtcgagaacggatgaagagaatcgaggaaggcatcaaggagctggggtcacagatcctgaaggagcatcctgtggaaaacactcagctgcagaatgagaaactgtatctgtactatctgcagaatggacgggatatgtacgtggaccaggagctggatattaacagactgagtgattatgacgtggatgccatcgtccctcagagcttcctgaaggatgactccattgacaacaaggtgctgaccaggtccgacaagaaccgcggcaaatcagataatgtgccaagcgaggaagtggtcaagaaaatgaagaactactggaggcagctgctgaatgccaagctgatcacacagcggaaatttgataacctgactaaggcagaaagaggaggcctgtctgagctggacaaggccggcttcatcaagcggcagctggtggagacaagacagatcactaagcacgtcgctcagattctggatagcagaatgaacacaaagtacgatgaaaacgacaagctgatcagggaggtgaaagtcattactctgaaatccaagctggtgtctgactttagaaaggatttccagttttataaagtcagggagatcaacaactaccaccatgctcatgacgcatacctgaacgcagtggtcgggaccgccctgattaagaaataccccaagctggagtccgagttcgtgtacggagactataaagtgtacgatgtccggaagatgatcgccaaatctgagcaggaaattggcaaggccaccgctaagtatttcttttacagtaacatcatgaatttctttaagaccgaaatcacactggcaaatggggagatcagaaaaaggcctctgattgagaccaacggggagacaggagaaatcgtgtgggacaagggaagggattttgctaccgtgcgcaaagtcctgtccatgccccaagtgaatattgtcaagaaaactgaagtgcagaccgggggattctctaaggagagtattctgcctaagcgaaactctgataaactgatcgcccggaagaaagactgggaccccaagaagtatggcgggttcgactctccaacagtggcttacagtgtcctggtggtcgcaaaggtggaaaaggggaagtccaagaaactgaagtctgtcaaagagctgctgggaatcactattatggaacgcagctccttcgagaagaatcctatcgattttctggaagccaagggctataaagaggtgaagaaagacctgatcattaagctgccaaaatactcactgtttgagctggaaaacggacgaaagcgaatgctggcaagcgccggagaactgcagaagggcaatgagctggccctgccctccaaatacgtgaacttcctgtatctggctagccactacgagaaactgaaggggtcccctgaggataacgaacagaagcagctgtttgtggagcagcacaaacattatctggacgagatcattgaacagatttcagagttcagcaagagagtgatcctggctgacgcaaatctggataaagtcctgagcgcatacaacaagcaccgagacaaaccaatccgggagcaggccgaaaatatcattcatctgttcaccctgacaaacctgggcgcccctgcagccttcaagtattttgacaccacaatcgatcggaagagatacacttctaccaaagaggtgctggatgctaccctgatccaccagagtattaccggcctgtatgagacacgcatcgacctgtcacagctgggaggcgatgggagccccaagaaaaagcggaaggtgtctagttaa

SEQ ID NO: 17015-17016 - skipped (2 entries)

SEQ ID NO: 17017 - protein, 557 aa, Homo Sapiens; identical to SEQ ID NO: 6740

SEQ ID NO: 17018 - protein, 515 aa, Homo Sapiens [sequence omitted]

SEQ ID NO: 17019 - protein, 338 aa, Homo Sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 17020 - protein, 246 aa, Homo Sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 17021 - protein, 154 aa, Homo Sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEAKQSSLPTIPIMGIVAGLVVLAAVVTGAAVAAVLWRKKSSD

SEQ ID NO: 17022 - protein, 246 aa, Homo Sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRAKQSSLPTIPIMGIVAGLVVLAAVVTGAAVAAVLWRKKSSD

SEQ ID NO: 17023 - protein, 319 aa, Homo Sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDL

SEQ ID NO: 17024 - protein, 227 aa, Homo Sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEADPPKTHVTHHPVFDYEATLRCWALGFYPAEIILTWQRDGEDQTQDVELVETRPAGDGTFQKWAAVVVPSGEEQRYTCHVQHEGLPEPLMLRWSKEGDGGIMSVRESRSLSEDL

SEQ ID NO: 17025 - protein, 116 aa, Homo Sapiens
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASE

SEQ ID NO: 17026 - protein, 526 aa, Homo Sapiens
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 17027 - protein, 565 aa, Influenza A virus
MKAKLLVLLCTFTATYADTICIGYHANNSTDTVDTVLEKNVTVTHSVNLLEDSHNGKLCLLKGIAPLQLGNCSVAGWILGNPECELLISKESWSYIVETPNPENGTCYPGYFADYEELREQLSSVSSFERFEIFPKESSWPNHTVTGVSASCSHNGKSSFYRNLLWLTGKNGLYPNLSKSYVNNKEKEVLVLWGVHHPPNIGNQRALYHTENAYVSVVSSHYSRRFTPEIAKRPKVRDQEGRINYYWTLLEPGDTIIFEANGNLIAPWYAFALSRGFGSGIITSNAPMDECDAKCQTPQGAINSSLPFQNVHPVTIGECPKYVRSAKLRMVTGLRNIPSIQSRGLFGAIAGFIEGGWTGMVDGWYGYHHQNEQGSGYAADQKSTQNAINGITNKVNSVIEKMNTQFTAVGKEFNKLERRMENLNKKVDDGFLDIWTYNAELLVLLENERTLDFHDSNVKNLYEKVKSQLKNNAKEIGNGCFEFYHKCNNECMESVKNGTYDYPKYSEESKLNREKIDGVKLESMGVYQILAIYSTVASSLVLLVSLGAISFWMCSNGSLQCRICI

SEQ ID NO: 17028 - protein, 243 aa, Homo Sapiens; identical to SEQ ID NO: 2367

SEQ ID NO: 17029 - protein, 191 aa, Homo Sapiens
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 17030 - protein, 246 aa, Homo Sapiens
MAAAAATKILLCLPLLLLLSGWSRAGRADPHSLCYDITVIPKFRPGPRWCAVQGQVDEKTFLHYDCGNKTVTPVSPLGKKLNVTTAWKAQNPVLREVVDILTEQLRDIQLENYTPKEPLTLQARMSCEQKAEGHSSGSWQFSFDGQIFLLFDSEKRMWTTVHPGARKMKEKWENDKVVAMSFHYFSMGDCIGWLEDFLMGMDSTLEPSAGAPLAMSSGTTQLRATATTLILCCLLIILPCFILPGI

SEQ ID NO: 17031 - protein, 244 aa, Homo Sapiens; identical to SEQ ID NO: 13925

SEQ ID NO: 17032 - protein, 383 aa, Homo Sapiens
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 17033 - protein, 383 aa, Homo Sapiens; identical to SEQ ID NO: 17032

SEQ ID NO: 17034 - protein, 294 aa, Homo Sapiens
MGGVLLTQRTLLSLVLALLFPSMASMEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHW

SEQ ID NO: 17035 - protein, 296 aa, Homo Sapiens
MGGVLLTQRTLLSLVLALLFPSMASMEPHSLRYNLTVLSWDGSVQSGFLTEVHLDGQPFLRCDRQKCRAKPQGQWAEDVLGNKTWDRETRDLTGNGKLDLRMTLAHIKLDQKEGLHSLQEIRVCEIHEDNSTRSSQHFYYNGELFLSQNLETKEWTMPQSSRAQTLTHYHAMHADCLQELRRYLKSGVVLRRTVPPMVDVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHW

SEQ ID NO: 17036-17057 - skipped (22 entries)

SEQ ID NO: 17058 - protein, 1588 aa, Artificial Sequence
  Synthetic Sequence
MPKKKRKVEGIKSNISLLKDELRGQISHISHEYLSLIDLAFDSKQNRLFEMKVLELLVNEYGFKGRHLGGSRKPDGIVYSTTLEDNFGIIVDTKAYSEGYSLPISQADEMERYVRENSNRDEEVNPNKWWENFSEEVKKYYFVFISGSFKGKFEEQLRRLSMTTGVNGSAVNVVNLLLGAEKIRSGEMTIEELERAMFNNSEFILKYGGGGSDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSPKKKRKV

SEQ ID NO: 17059 - DNA, 4767 bp, Artificial Sequence
  Synthetic Sequence
atgcctaagaagaagcggaaggtggaaggcatcaaaagcaacatctccctcctgaaagacgaactccgggggcagattagccacattagtcacgaatacctctccctcatcgacctggctttcgatagcaagcagaacaggctctttgagatgaaagtgctggaactgctcgtcaatgagtacgggttcaagggtcgacacctcggcggatctaggaaaccagacggcatcgtgtatagtaccacactggaagacaactttgggatcattgtggataccaaggcatactctgagggttatagtctgcccatttcacaggccgacgagatggaacggtacgtgcgcgagaactcaaatagagatgaggaagtcaaccctaacaagtggtgggagaacttctctgaggaagtgaagaaatactacttcgtctttatcagcgggtccttcaagggtaaatttgaggaacagctcaggagactgagcatgactaccggcgtgaatggcagcgccgtcaacgtggtcaatctgctcctgggcgctgaaaagattcggagcggagagatgaccatcgaagagctggagagggcaatgtttaataatagcgagtttatcctgaaatacggtggcggtggatccgataaaaagtattctattggtttagccatcggcactaattccgttggatgggctgtcataaccgatgaatacaaagtaccttcaaagaaatttaaggtgttggggaacacagaccgtcattcgattaaaaagaatcttatcggtgccctcctattcgatagtggcgaaacggcagaggcgactcgcctgaaacgaaccgctcggagaaggtatacacgtcgcaagaaccgaatatgttacttacaagaaatttttagcaatgagatggccaaagttgacgattctttctttcaccgtttggaagagtccttccttgtcgaagaggacaagaaacatgaacggcaccccatctttggaaacatagtagatgaggtggcatatcatgaaaagtacccaacgatttatcacctcagaaaaaagctagttgactcaactgataaagcggacctgaggttaatctacttggctcttgcccatatgataaagttccgtgggcactttctcattgagggtgatctaaatccggacaactcggatgtcgacaaactgttcatccagttagtacaaacctataatcagttgtttgaagagaaccctataaatgcaagtggcgtggatgcgaaggctattcttagcgcccgcctctctaaatcccgacggctagaaaacctgatcgcacaattacccggagagaagaaaaatgggttgttcggtaaccttatagcgctctcactaggcctgacaccaaattttaagtcgaacttcgacttagctgaagatgccaaattgcagcttagtaaggacacgtacgatgacgatctcgacaatctactggcacaaattggagatcagtatgcggacttatttttggctgccaaaaaccttagcgatgcaatcctcctatctgacatactgagagttaatactgagattaccaaggcgccgttatccgcttcaatgatcaaaaggtacgatgaacatcaccaagacttgacacttctcaaggccctagtccgtcagcaactgcctgagaaatataaggaaatattctttgatcagtcgaaaaacgggtacgcaggttatattgacggcggagcgagtcaagaggaattctacaagtttatcaaacccatattagagaagatggatgggacggaagagttgcttgtaaaactcaatcgcgaagatctactgcgaaagcagcggactttcgacaacggtagcattccacatcaaatccacttaggcgaattgcatgctatacttagaaggcaggaggatttttatccgttcctcaaagacaatcgtgaaaagattgagaaaatcctaacctttcgcataccttactatgtgggacccctggcccgagggaactctcggttcgcatggatgacaagaaagtccgaagaaacgattactccatggaattttgaggaagttgtcgataaaggtgcgtcagctcaatcgttcatcgagaggatgaccaactttgacaagaatttaccgaacgaaaaagtattgcctaagcacagtttactttacgagtatttcacagtgtacaatgaactcacgaaagttaagtatgtcactgagggcatgcgtaaacccgcctttctaagcggagaacagaagaaagcaatagtagatctgttattcaagaccaaccgcaaagtgacagttaagcaattgaaagaggactactttaagaaaattgaatgcttcgattctgtcgagatctccggggtagaagatcgatttaatgcgtcacttggtacgtatcatgacctcctaaagataattaaagataaggacttcctggataacgaagagaatgaagatatcttagaagatatagtgttgactcttaccctctttgaagatcgggaaatgattgaggaaagactaaaaacatacgctcacctgttcgacgataaggttatgaaacagttaaagaggcgtcgctatacgggctggggacgattgtcgcggaaacttatcaacgggataagagacaagcaaagtggtaaaactattctcgattttctaaagagcgacggcttcgccaataggaactttatgcagctgatccatgatgactctttaaccttcaaagaggatatacaaaaggcacaggtttccggacaaggggactcattgcacgaacatattgcgaatcttgctggttcgccagccatcaaaaagggcatactccagacagtcaaagtagtggatgagctagttaaggtcatgggacgtcacaaaccggaaaacattgtaatcgagatggcacgcgaaaatcaaacgactcagaaggggcaaaaaaacagtcgagagcggatgaagagaatagaagagggtattaaagaactgggcagccagatcttaaaggagcatcctgtggaaaatacccaattgcagaacgagaaactttacctctattacctacaaaatggaagggacatgtatgttgatcaggaactggacataaaccgtttatctgattacgacgtcgatgccattgtaccccaatcctttttgaaggacgattcaatcgacaataaagtgcttacacgctcggataagaaccgagggaaaagtgacaatgttccaagcgaggaagtcgtaaagaaaatgaagaactattggcggcagctcctaaatgcgaaactgataacgcaaagaaagttcgataacttaactaaagctgagaggggtggcttgtctgaacttgacaaggccggatttattaaacgtcagctcgtggaaacccgccaaatcacaaagcatgttgcacagatactagattcccgaatgaatacgaaatacgacgagaacgataagctgattcgggaagtcaaagtaatcactttaaagtcaaaattggtgtcggacttcagaaaggattttcaattctataaagttagggagataaataactaccaccatgcgcacgacgcttatcttaatgccgtcgtagggaccgcactcattaagaaatacccgaagctagaaagtgagtttgtgtatggtgattacaaagtttatgacgtccgtaagatgatcgcgaaaagcgaacaggagataggcaaggctacagccaaatacttcttttattctaacattatgaatttctttaagacggaaatcactctggcaaacggagagatacgcaaacgacctttaattgaaaccaatggggagacaggtgaaatcgtatgggataagggccgggacttcgcgacggtgagaaaagttttgtccatgccccaagtcaacatagtaaagaaaactgaggtgcagaccggagggttttcaaaggaatcgattcttccaaaaaggaatagtgataagctcatcgctcgtaaaaaggactgggacccgaaaaagtacggtggcttcgatagccctacagttgcctattctgtcctagtagtggcaaaagttgagaagggaaaatccaagaaactgaagtcagtcaaagaattattggggataacgattatggagcgctcgtcttttgaaaagaaccccatcgacttccttgaggcgaaaggttacaaggaagtaaaaaaggatctcataattaaactaccaaagtatagtctgtttgagttagaaaatggccgaaaacggatgttggctagcgccggagagcttcaaaaggggaacgaactcgcactaccgtctaaatacgtgaatttcctgtatttagcgtcccattacgagaagttgaaaggttcacctgaagataacgaacagaagcaactttttgttgagcagcacaaacattatctcgacgaaatcatagagcaaatttcggaattcagtaagagagtcatcctagctgatgccaatctggacaaagtattaagcgcatacaacaagcacagggataaacccatacgtgagcaggcggaaaatattatccatttgtttactcttaccaacctcggcgctccagccgcattcaagtattttgacacaacgatagatcgcaaacgatacacttctaccaaggaggtgctagacgcgacactgattcaccaatccatcacgggattatatgaaactcggatagatttgtcacagcttgggggtgacggatcccccaagaagaagaggaaagtctga

SEQ ID NO: 17060-17094 - skipped (35 entries)

SEQ ID NO: 17095 - DNA, 561 bp, Artificial Sequence
  Synthetic Sequence
atggtcgggtctctgaattgtatcgtcgccgtgagtcagaacatgggcattgggaagaatggcgatttcccatggccacctctgcgcaacgagtcccgatactttcagcggatgacaactacctcctctgtggaagggaaacagaatctggtcatcatgggaaagaaaacttggttcagcattccagagaagaaccggcccctgaaaggcagaatcaatctggtgctgtcccgagaactgaaggagccaccacagggagctcactttctgagccggtccctggacgatgcactgaagctgacagaacagcctgagctggccaacaaagtcgatatggtgtggatcgtcgggggaagttcagtgtataaggaggccatgaatcaccccggccatctgaaactgttcgtcacacggatcatgcaggactttgagagcgatactttctttcctgaaattgacctggagaagtacaaactgctgcccgaatatcctggcgtgctgtccgatgtccaggaagagaaaggcatcaaatacaagttcgaggtctatgagaagaatgac

SEQ ID NO: 17096 - DNA, 35 bp, Artificial Sequence
  Synthetic Sequence
ccctagaaagatagtctgcgtaaaattgacgcatg

SEQ ID NO: 17097 - DNA, 63 bp, Artificial Sequence
  Synthetic Sequence
ccctagaaagataatcatattgtgacgtacgttaaagataatcatgcgtaaaattgacgcatg

SEQ ID NO: 17098 - DNA, 63 bp, Artificial Sequence
  Synthetic Sequence
ccctagaaagataatcatattgtgacgtacgttaaagataatcatgtgtaaaattgacgcatg

SEQ ID NO: 17099 - DNA, 241 bp, Artificial Sequence
  Synthetic Sequence
ttaaccctagaaagataatcatattgtgacgtacgttaaagataatcatgtgtaaaattgacgcatgtgttttatcggtctgtatatcgaggtttatttattaatttgaatagatattaagttttattatatttacacttacatactaataataaattcaacaaacaatttatttatgtttatttatttattaaaaaaaacaaaaactcaaaatttcttctataaagtaacaaaactttta

SEQ ID NO: 17100-17499 - skipped (400 entries)

SEQ ID NO: 17500 - DNA, 5296 bp, Artificial Sequence; identical to SEQ ID NO: 17006
  Synthetic Sequence

SEQ ID NO: 17501 - DNA, 4682 bp, Artificial Sequence; identical to SEQ ID NO: 17007
  Synthetic Sequence

SEQ ID NO: 17502 - DNA, 4897 bp, Artificial Sequence
  Synthetic Sequence
tgtacatagattaaccctagaaagataatcatattgtgacgtacgttaaagataatcatgcgtaaaattgacgcatgtgttttatcggtctgtatatcgaggtttatttattaatttgaatagatattaagttttattatatttacacttacatactaataataaattcaacaaacaatttatttatgtttatttatttattaaaaaaaaacaaaaactcaaaatttcttctataaagtaacaaaacttttatcgaatacctgcagcccgggggatgcagagggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaagttgactgtgcctttcgatcgaaccatggacagttagctttgcaaagatggataaagttttaaacagagaggaatctttgcagctaatggaccttctaggtcttgaaaggagtgggaattggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagaattctaatacgactcactatagggtgtgctgtctcatcattttggcaaagattggccaccaagcttgtcctgcaggagggtcgacgcctctagacgggcggccgctccggatccacgggtaccgatcacatatgcctttaattaaacactagttctatagtgtcacctaaattccctttagtgagggttaatggccgtaggccgccagaattgggtccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttcggactctaggacctgcgcatgcgcttggcgtaatcatggtcatagctgtttcctgttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccctctcaccgcggtggagctccagcttttgttcgaattggggccccccctcgagggtatcgatgatatctataacaagaaaatatatatataataagttatcacgtaagtagaacatgaaataacaatataattatcgtatgagttaaatcttaaaagtcacgtaaaagataatcatgcgtcattttgactcacgcggtcgttatagttcaaaatcagtgacacttaccgcattgacaagcacgcctcacgggagctccaagcggcgactgagatgtcctaaatgcacagcgacggattcgcgctatttagaaagagagagcaatatttcaagaatgcatgcgtcaattttacgcagactatctttctagggttaatctagctagccttaagggcgcctattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgagattatcaaaaaggatcttcacctagatccttttaaattaaaaatgaagttttaaatcaatctaaagtatatatgagtaaacttggtctgacagtcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcataatattattgaagcatttatcagggttcgtctcgtcccggtctcctcccaatgcatgtcaatattggccattagccatattattcattggttatatagcataaatcaatattggctattggccattgcatacgttgtatctatatcataata

SEQ ID NO: 17503 - protein, 21 aa, Homo Sapiens
MALPVTALLLPLALLLHAARP

SEQ ID NO: 17504 - DNA, 63 bp, Homo Sapiens
atggcactgccagtcaccgccctgctgctgcctctggctctgctgctgcacgcagctagacca

SEQ ID NO: 17505 - protein, 24 aa, Homo Sapiens
IYIWAPLAGTCGVLLLSLVITLYC

SEQ ID NO: 17506 - DNA, 72 bp, Homo sapiens
atctacatttgggcaccactggccgggacctgtggagtgctgctgctgagcctggtcatcacactgtactgc

SEQ ID NO: 17507 - protein, 112 aa, Homo Sapiens
RVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 17508 - DNA, 336 bp, Homo sapiens
cgcgtgaagtttagtcgatcagcagatgccccagcttacaaacagggacagaaccagctgtataacgagctgaatctgggccgccgagaggaatatgacgtgctggataagcggagaggacgcgaccccgaaatgggaggcaagcccaggcgcaaaaaccctcaggaaggcctgtataacgagctgcagaaggacaaaatggcagaagcctattctgagatcggcatgaagggggagcgacggagaggcaaagggcacgatgggctgtaccagggactgagcaccgccacaaaggacacctatgatgctctgcatatgcaggcactgcctccaagg

SEQ ID NO: 17509 - protein, 42 aa, Homo Sapiens
KRGRKKLLYIFKQPFMRPVQTTQEEDGCSCRFPEEEEGGCEL

SEQ ID NO: 17510 - DNA, 126 bp, Homo sapiens
aagagaggcaggaagaaactgctgtatattttcaaacagcccttcatgcgccccgtgcagactacccaggaggaagacgggtgctcctgtcgattccctgaggaagaggaaggcgggtgtgagctg

SEQ ID NO: 17511 - protein, 45 aa, Homo Sapiens
TTTPAPRPPTPAPTIASQPLSLRPEACRPAAGGAVHTRGLDFACD

SEQ ID NO: 17512 - DNA, 135 bp, Homo sapiens
actaccacaccagcacctagaccaccaactccagctccaaccatcgcgagtcagcccctgagtctgagacctgaggcctgcaggccagctgcaggaggagctgtgcacaccaggggcctggacttcgcctgcgac

SEQ ID NO: 17513 - DNA, 135 bp, Homo sapiens
accacaacccctgcccccagacctcccacacccgcccctaccatcgcgagtcagcccctgagtctgagacctgaggcctgcaggccagctgcaggaggagctgtgcacaccaggggcctggacttcgcctgcgac

SEQ ID NO: 17514 - protein, 89 aa, Homo Sapiens
LPAPKNLVVSEVTEDSLRLSWTAPDAAFDSFLIQYQESEKVGEAINLTVPGSERSYDLTGLKPGTEYTVSIYGVKGGHRSNPLSAEFTT

SEQ ID NO: 17515 - protein, 90 aa, Homo Sapiens
MLPAPKNLVVSEVTEDSLRLSWTAPDAAFDSFLIQYQESEKVGEAINLTVPGSERSYDLTGLKPGTEYTVSIYGVKGGHRSNPLSAEFTT

SEQ ID NO: 17516 - protein, 4 aa, Artificial Sequence
  Synthetic Sequence
TEDS

SEQ ID NO: 17517 - protein, 7 aa, Artificial Sequence
  Synthetic Sequence
TAPDAAF

SEQ ID NO: 17518 - protein, 6 aa, Artificial Sequence
  Synthetic Sequence
SEKVGE

SEQ ID NO: 17519 - protein, 4 aa, Artificial Sequence
  Synthetic Sequence
GSER

SEQ ID NO: 17520 - protein, 5 aa, Artificial Sequence
  Synthetic Sequence
GLKPG

SEQ ID NO: 17521 - protein, 7 aa, Artificial Sequence
  Synthetic Sequence
KGGHRSN

SEQ ID NO: 17522-17999 - skipped (478 entries)

SEQ ID NO: 18000 - protein, 362 aa, Artificial Sequence
  Synthetic Sequence
MALPVTALLLPLALLLHAARPEVQLLESGGGLVQPGGSLRLSCAASGFTFSSYAMNWVRQAPGKGLEWVAGIIGSGGSTYYADSVKGRFSISRDNSKNTLDLQMNSLRAEDTAVYYCVKDWNTTMITERGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 18001 - DNA, 1089 bp, Artificial Sequence
  Synthetic Sequence
atggctctgcctgtgacagctctgctgctgcctctggctctgcttcttcatgcggcgcgccctgaagttcagctgcttgaatctggcggaggcctggttcaacctggcggatctctgagactgagctgtgccgccagcggcttcacctttagcagctacgccatgaactgggtccgacaggcccctggcaaaggactggaatgggtggccggaatcatcggcagcggcggcagcacatattacgccgattctgtgaagggccgcttcagcatcagccgggacaacagcaagaacaccctggacctgcagatgaacagcctgagagccgaggataccgccgtgtactactgcgtgaaggattggaacaccaccatgatcaccgagagaggccagggcacactggtcaccgtgtcctctacaacaacaccggcgcctcggcctccaacaccagctcctacaatcgcgagtcagcccctgtctctcagacccgaagcctgtagacctgctgctggcggagctgtgcataccagaggactggatttcgcctgcgacatctacatctgggctcctctggctggcacatgcggagttttgctgctgagcctggtcatcaccctgtactgtaagagaggcaggaagaagctgctgtatatcttcaagcagcccttcatgagacccgtgcagaccacacaggaggaggacggctgctcttgtaggttcccagaggaggaggagggaggatgcgagctgcgcgtgaagtttagccggtccgccgatgcacctgcatacaagcagggacagaaccagctgtataacgagctgaatctgggccggagagaggagtacgacgtgctggataagaggcggggccgggaccccgagatgggaggcaagcctcggagaaagaacccacaggagggcctgtacaatgagctgcaaaaggacaagatggccgaggcctattctgagatcggcatgaagggagagaggcgccggggcaagggacacgatggcctgtaccagggcctgagcaccgccacaaaggacacctatgatgccctgcacatgcaggccctgccccctagatga

SEQ ID NO: 18002 - protein, 362 aa, Artificial Sequence
  Synthetic Sequence
MALPVTALLLPLALLLHAARPEVQLLESGGGLVQPGGSLTLSCAASGFTFSNYAMNWVRQAPGKGLEWVSGIIGSGATTYYADSVKGRFTISRDNSKNTLNLQMNSLRAEDTAIYYCVKDWNTTMITERGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 18003 - DNA, 1089 bp, Artificial Sequence
  Synthetic Sequence
atggctctgcctgtgacagctctgctgctgcctctggctctgcttcttcatgcggcgcgccctgaagttcagctgcttgaatctggcggaggcctggttcaacctggcggatctctgacactgagctgtgccgccagcggcttcaccttcagcaactacgccatgaactgggtccgacaggcccctggcaaaggccttgaatgggtgtccggcatcattggctctggcgccaccacctactacgccgattctgtgaagggcagattcaccatcagccgggacaacagcaagaacaccctgaacctgcagatgaacagcctgagagccgaggacaccgccatctactactgcgtgaaggactggaacaccaccatgatcaccgagagaggccagggcacactggtcaccgtgtcctctacaacaacaccggcgcctcggcctccaacaccagctcctacaatcgcgagtcagcccctgtctctcagacccgaagcctgtagacctgctgctggcggagctgtgcataccagaggactggatttcgcctgcgacatctacatctgggctcctctggctggcacatgcggagttttgctgctgagcctggtcatcaccctgtactgtaagagaggcaggaagaagctgctgtatatcttcaagcagcccttcatgagacccgtgcagaccacacaggaggaggacggctgctcttgtaggttcccagaggaggaggagggaggatgcgagctgcgcgtgaagtttagccggtccgccgatgcacctgcatacaagcagggacagaaccagctgtataacgagctgaatctgggccggagagaggagtacgacgtgctggataagaggcggggccgggaccccgagatgggaggcaagcctcggagaaagaacccacaggagggcctgtacaatgagctgcaaaaggacaagatggccgaggcctattctgagatcggcatgaagggagagaggcgccggggcaagggacacgatggcctgtaccagggcctgagcaccgccacaaaggacacctatgatgccctgcacatgcaggccctgccccctagatga

SEQ ID NO: 18004 - protein, 362 aa, Artificial Sequence
  Synthetic Sequence
MALPVTALLLPLALLLHAARPEVQLLESGGGLVQPGESLRLSCAASGFTFSNYAMNWVRQAPGKGLEWVSGIVGGGGTSYYADSVRGRFTISRDNSKNTLYLQMNSLRAEDTAVYYCVKDWNTTMITERGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 18005 - DNA, 1089 bp, Artificial Sequence
  Synthetic Sequence
atggctctgcctgtgacagctctgctgctgcctctggctctgcttcttcatgcggcgcgccctgaagttcagctgcttgaatctggcggaggcctggttcagcctggcgaatctctgagactgagctgtgccgccagcggcttcaccttcagcaactacgccatgaactgggtccgacaggcccctggcaaaggccttgaatgggtgtccggaatcgttggcggcggaggcacaagctactacgccgattctgtgcggggcagattcaccatcagccgggacaacagcaagaacaccctgtacctgcagatgaacagcctgagagccgaggacaccgccgtgtactactgcgtgaaggactggaacaccaccatgatcaccgagagaggccagggcacactggtcaccgtgtcctctacaacaacaccggcgcctcggcctccaacaccagctcctacaatcgcgagtcagcccctgtctctcagacccgaagcctgtagacctgctgctggcggagctgtgcataccagaggactggatttcgcctgcgacatctacatctgggctcctctggctggcacatgcggagttttgctgctgagcctggtcatcaccctgtactgtaagagaggcaggaagaagctgctgtatatcttcaagcagcccttcatgagacccgtgcagaccacacaggaggaggacggctgctcttgtaggttcccagaggaggaggagggaggatgcgagctgcgcgtgaagtttagccggtccgccgatgcacctgcatacaagcagggacagaaccagctgtataacgagctgaatctgggccggagagaggagtacgacgtgctggataagaggcggggccgggaccccgagatgggaggcaagcctcggagaaagaacccacaggagggcctgtacaatgagctgcaaaaggacaagatggccgaggcctattctgagatcggcatgaagggagagaggcgccggggcaagggacacgatggcctgtaccagggcctgagcaccgccacaaaggacacctatgatgccctgcacatgcaggccctgccccctagatga

SEQ ID NO: 18006 - protein, 362 aa, Artificial Sequence
  Synthetic Sequence
MALPVTALLLPLALLLHAARPEVQLLESGGGLVQPGGSLRLSCAASGFTFSNYAMTWIRQAPGKGLEWVSGITGDGGSTFYADSVKGRFTISRDNSKNTLYLQMNSLRAEDTAVYYCVKDWNTTMITERGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 18007 - DNA, 1089 bp, Artificial Sequence
  Synthetic Sequence
atggctctgcctgtgacagctctgctgctgcctctggctctgcttcttcatgcggcgcgccctgaagttcagctgcttgaatctggcggaggcctggttcaacctggcggatctctgagactgagctgtgccgccagcggcttcaccttcagcaattacgccatgacctggatcagacaggcccctggcaaaggcctggaatgggtgtccggaattacaggcgacggcggcagcaccttttacgccgattctgtgaagggcagattcaccatcagccgggacaacagcaagaacaccctgtacctgcagatgaacagcctgagagccgaggacaccgccgtgtactactgcgtgaaggactggaacaccaccatgatcaccgagagaggccagggcacactggtcaccgtgtcctctacaacaacaccggcgcctcggcctccaacaccagctcctacaatcgcgagtcagcccctgtctctcagacccgaagcctgtagacctgctgctggcggagctgtgcataccagaggactggatttcgcctgcgacatctacatctgggctcctctggctggcacatgcggagttttgctgctgagcctggtcatcaccctgtactgtaagagaggcaggaagaagctgctgtatatcttcaagcagcccttcatgagacccgtgcagaccacacaggaggaggacggctgctcttgtaggttcccagaggaggaggagggaggatgcgagctgcgcgtgaagtttagccggtccgccgatgcacctgcatacaagcagggacagaaccagctgtataacgagctgaatctgggccggagagaggagtacgacgtgctggataagaggcggggccgggaccccgagatgggaggcaagcctcggagaaagaacccacaggagggcctgtacaatgagctgcaaaaggacaagatggccgaggcctattctgagatcggcatgaagggagagaggcgccggggcaagggacacgatggcctgtaccagggcctgagcaccgccacaaaggacacctatgatgccctgcacatgcaggccctgccccctagatga

SEQ ID NO: 18008 - protein, 362 aa, Artificial Sequence
  Synthetic Sequence
MALPVTALLLPLALLLHAARPEVQLLESGGGLAQPGGSLRLSCAASGFTFSSYAMNWIRQAPGKGLEWVSGISGSGGSTYYADSVKGRFTISRDNSKNTVYLQMNSLRAEDTAVYYCVKDWNTTMITERGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 18009 - DNA, 1089 bp, Artificial Sequence
  Synthetic Sequence
atggcactgcctgtgacagccctgctgctgcctctggccctgctgctgcacgcagcacggcccgaggtgcagctgctggagtccggaggaggcctggcccagcctggcggcagcctgaggctgtcctgcgccgcctctggcttcacctttagctcctacgccatgaactggatcagacaggcccctggcaagggcctggagtgggtgtccggcatctccggctctggaggctctacatactatgccgacagcgtgaagggccggttcaccatcagcagagataactccaagaataccgtgtacctccagatgaactctctgcgggccgaggacaccgccgtgtactattgcgtgaaggattggaataccacaatgatcacagagaggggccagggcaccctggtgacagtgtctagcaccacaacccctgcccccagacctcccacacccgcccctaccatcgcgagtcagccactgtccctgcggcctgaggcctgccggcccgccgccggcggagcagtgcacacacggggcctggactttgcctgtgacatctacatatgggcaccactggcaggaacctgcggcgtgctgctgctgagcctggtcatcaccctgtactgtaagagaggcaggaagaagctgctgtatatcttcaagcagcccttcatgagacccgtgcagaccacacaggaggaggacggctgctcttgtaggttcccagaggaggaggagggaggatgcgagctgcgcgtgaagtttagccggtccgccgatgcacctgcatacaagcagggacagaaccagctgtataacgagctgaatctgggccggagagaggagtacgacgtgctggataagaggcggggccgggaccccgagatgggaggcaagcctcggagaaagaacccacaggagggcctgtacaatgagctgcaaaaggacaagatggccgaggcctattctgagatcggcatgaagggagagaggcgccggggcaagggacacgatggcctgtaccagggcctgagcaccgccacaaaggacacctatgatgccctgcacatgcaggccctgccccctagatga

SEQ ID NO: 18010 - protein, 362 aa, Artificial Sequence
  Synthetic Sequence
MALPVTALLLPLALLLHAARPEVQLLESGGGLVQPGRSLRLSCAASGFTFTNYAMNWVRQAPGKGLEWVSGISGGGGSTYYADSVKGRFTISRDNSKNTLYLQMNSLRAEDTAVYYCVKDWNTTMITERGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 18011 - DNA, 1089 bp, Artificial Sequence
  Synthetic Sequence
atggcactgcctgtgacagccctgctgctgcctctggccctgctgctgcacgcagcacggcccgaggtgcagctgctggagtctggaggaggcctggtgcagcccggccggtccctgagactgtcttgcgccgccagcggcttcacctttacaaactacgccatgaattgggtgcggcaggcccctggcaagggcctggagtgggtgtctggcatcagcggaggaggaggcagcacctactatgcagactccgtgaagggcaggttcaccatctcccgcgataactctaagaatacactgtacctccagatgaacagcctgagggcagaggacaccgccgtgtactattgcgtgaaggattggaataccacaatgatcacagagaggggacagggcaccctggtgaccgtgagcagcaccacaacccctgcccccagacctcccacacccgcccctaccatcgcgagtcagccactgtccctgcggcctgaggcctgccggcccgccgccggcggagcagtgcacacacggggcctggactttgcctgtgacatctacatatgggcaccactggcaggaacctgcggcgtgctgctgctgagcctggtcatcaccctgtactgtaagagaggcaggaagaagctgctgtatatcttcaagcagcccttcatgagacccgtgcagaccacacaggaggaggacggctgctcttgtaggttcccagaggaggaggagggaggatgcgagctgcgcgtgaagtttagccggtccgccgatgcacctgcatacaagcagggacagaaccagctgtataacgagctgaatctgggccggagagaggagtacgacgtgctggataagaggcggggccgggaccccgagatgggaggcaagcctcggagaaagaacccacaggagggcctgtacaatgagctgcaaaaggacaagatggccgaggcctattctgagatcggcatgaagggagagaggcgccggggcaagggacacgatggcctgtaccagggcctgagcaccgccacaaaggacacctatgatgccctgcacatgcaggccctgccccctagatga

SEQ ID NO: 18012 - protein, 21 aa, Artificial Sequence
  Synthetic Sequence
MALPVTALLLPLALLLHAARP

SEQ ID NO: 18013 - DNA, 63 bp, Artificial Sequence; identical to SEQ ID NO: 17504
  Synthetic Sequence

SEQ ID NO: 18014 - protein, 24 aa, Artificial Sequence
  Synthetic Sequence
IYIWAPLAGTCGVLLLSLVITLYC

SEQ ID NO: 18015 - DNA, 72 bp, Artificial Sequence; identical to SEQ ID NO: 17506
  Synthetic Sequence

SEQ ID NO: 18016 - protein, 112 aa, Artificial Sequence; identical to SEQ ID NO: 17507
  Synthetic Sequence

SEQ ID NO: 18017 - DNA, 336 bp, Artificial Sequence; identical to SEQ ID NO: 17508
  Synthetic Sequence

SEQ ID NO: 18018 - protein, 42 aa, Artificial Sequence; identical to SEQ ID NO: 17509
  Synthetic Sequence

SEQ ID NO: 18019 - DNA, 126 bp, Artificial Sequence; identical to SEQ ID NO: 17510
  Synthetic Sequence

SEQ ID NO: 18020 - protein, 45 aa, Artificial Sequence; identical to SEQ ID NO: 17511
  Synthetic Sequence

SEQ ID NO: 18021 - DNA, 135 bp, Artificial Sequence; identical to SEQ ID NO: 17512
  Synthetic Sequence

SEQ ID NO: 18022 - protein, 107 aa, Homo Sapiens; identical to SEQ ID NO: 14635

SEQ ID NO: 18023 - DNA, 321 bp, Homo Sapiens; identical to SEQ ID NO: 14636

SEQ ID NO: 18024 - protein, 5 aa, Artificial Sequence
  Synthetic Sequence
GGGGS

SEQ ID NO: 18025 - protein, 15 aa, Artificial Sequence
  Synthetic Sequence
GGAGGAGGAGGATCC

SEQ ID NO: 18026 - protein, 282 aa, Artificial Sequence; identical to SEQ ID NO: 14639
  Synthetic Sequence

SEQ ID NO: 18027 - DNA, 843 bp, Artificial Sequence
  Synthetic Sequence
tttggggacgtgggggccctggagtctctgcgaggaaatgccgatctggcttacatcctgagcatggaaccctgcggccactgtctgatcattaacaatgtgaacttctgcagagaaagcggactgcgaacacggactggctccaatattgactgtgagaagctgcggagaaggttctctagtctgcactttatggtcgaagtgaaaggggatctgaccgccaagaaaatggtgctggccctgctggagctggctcagcaggaccatggagctctggattgctgcgtggtcgtgatcctgtcccacgggtgccaggcttctcatctgcagttccccggagcagtgtacggaacagacggctgtcctgtcagcgtggagaagatcgtcaacatcttcaacggcacttcttgccctagtctggggggaaagccaaaactgttctttatccaggcctgtggcggggaacagaaagatcacggcttcgaggtggccagcaccagccctgaggacgaatcaccagggagcaaccctgaaccagatgcaactccattccaggagggactgaggacctttgaccagctggatgctatctcaagcctgcccactcctagtgacattttcgtgtcttacagtaccttcccaggctttgtctcatggcgcgatcccaagtcagggagctggtacgtggagacactggacgacatctttgaacagtgggcccattcagaggacctgcagagcctgctgctgcgagtggcaaacgctgtctctgtgaagggcatctacaaacagatgcccgggtgcttcaattttctgagaaagaaactgttctttaagacttcc

SEQ ID NO: 18028 - protein, 394 aa, Artificial Sequence; identical to SEQ ID NO: 14641
  Synthetic Sequence

SEQ ID NO: 18029 - DNA, 1182 bp, Artificial Sequence; identical to SEQ ID NO: 14642
  Synthetic Sequence

SEQ ID NO: 18030 - protein, 18 aa, Artificial Sequence
  Synthetic Sequence
EGRGSLLTCGDVEENPGP

SEQ ID NO: 18031 - protein, 21 aa, Artificial Sequence
  Synthetic Sequence
GSGEGRGSLLTCGDVEENPGP

SEQ ID NO: 18032 - DNA, 63 bp, Artificial Sequence
  Synthetic Sequence
ggatctggagagggaaggggaagcctgctgacctgtggagacgtggaggaaaacccaggacca

SEQ ID NO: 18033 - protein, 20 aa, Artificial Sequence
  Synthetic Sequence
QCTNYALLKLAGDVESNPGP

SEQ ID NO: 18034 - protein, 23 aa, Artificial Sequence
  Synthetic Sequence
GSGQCTNYALLKLAGDVESNPGP

SEQ ID NO: 18035 - protein, 22 aa, Artificial Sequence
  Synthetic Sequence
VKQTLNFDLLKLAGDVESNPGP

SEQ ID NO: 18036 - protein, 25 aa, Artificial Sequence
  Synthetic Sequence
GSGVKQTLNFDLLKLAGDVESNPGP

SEQ ID NO: 18037 - protein, 19 aa, Artificial Sequence
  Synthetic Sequence
ATNFSLLKQAGDVEENPGP

SEQ ID NO: 18038 - protein, 22 aa, Artificial Sequence
  Synthetic Sequence
GSGATNFSLLKQAGDVEENPGP

SEQ ID NO: 18039 - skipped

SEQ ID NO: 18040 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 18041 - protein, 1053 aa, Artificial Sequence
  Synthetic Sequence
MKRNYILGLAIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEEASKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 18042 - protein, 1368 aa, Artificial Sequence
  Synthetic Sequence
  misc_feature (1)..(1): Xaa can be any naturally occurring amino acid
XDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18043 - protein, 1368 aa, Artificial Sequence
  Synthetic Sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 18044 - protein, 199 aa, Artificial Sequence
  Synthetic Sequence
EGIKSNISLLKDELRGQISHISHEYLSLIDLAFDSKQNRLFEMKVLELLVNEYGFKGRHLGGSRKPDGIVYSTTLEDNFGIIVDTKAYSEGYSLPISQADEMERYVRENSNRDEEVNPNKWWENFSEEVKKYYFVFISGSFKGKFEEQLRRLSMTTGVNGSAVNVVNLLLGAEKIRSGEMTIEELERAMFNNSEFILKY

SEQ ID NO: 18045 - protein, 1591 aa, Artificial Sequence; identical to SEQ ID NO: 17013
  Synthetic Sequence

SEQ ID NO: 18046 - DNA, 4776 bp, Artificial Sequence; identical to SEQ ID NO: 17014
  Synthetic Sequence

SEQ ID NO: 18047 - protein, 1588 aa, Artificial Sequence; identical to SEQ ID NO: 17058
  Synthetic Sequence

SEQ ID NO: 18048 - DNA, 4767 bp, Artificial Sequence; identical to SEQ ID NO: 17059
  Synthetic Sequence

SEQ ID NO: 18049 - skipped

SEQ ID NO: 18050 - protein, 118 aa, Artificial Sequence
  Synthetic Sequence
EVQLLESGGGLVQPGGSLTLSCAASGFTFSNYAMNWVRQAPGKGLEWVSGIIGSGATTYYADSVKGRFTISRDNSKNTLNLQMNSLRAEDTAIYYCVKDWNTTMITERGQGTLVTVSS

SEQ ID NO: 18051 - protein, 118 aa, Artificial Sequence
  Synthetic Sequence
EVQLLESGGGLVQPGGSLRLSCAASGFTFSNYAMTWIRQAPGKGLEWVSGITGDGGSTFYADSVKGRFTISRDNSKNTLYLQMNSLRAEDTAVYYCVKDWNTTMITERGQGTLVTVSS

SEQ ID NO: 18052 - protein, 118 aa, Artificial Sequence
  Synthetic Sequence
EVQLLESGGGLVQPGGSLRLSCAASGFTFSSYAMNWVRQAPGKGLEWVAGIIGSGGSTYYADSVKGRFSISRDNSKNTLDLQMNSLRAEDTAVYYCVKDWNTTMITERGQGTLVTVSS

SEQ ID NO: 18053 - protein, 118 aa, Artificial Sequence
  Synthetic Sequence
EVQLLESGGGLAQPGGSLRLSCAASGFTFSSYAMNWIRQAPGKGLEWVSGISGSGGSTYYADSVKGRFTISRDNSKNTVYLQMNSLRAEDTAVYYCVKDWNTTMITERGQGTLVTVSS

SEQ ID NO: 18054 - protein, 118 aa, Artificial Sequence
  Synthetic Sequence
EVQLLESGGGLVQPGRSLRLSCAASGFTFTNYAMNWVRQAPGKGLEWVSGISGGGGSTYYADSVKGRFTISRDNSKNTLYLQMNSLRAEDTAVYYCVKDWNTTMITERGQGTLVTVSS

SEQ ID NO: 18055 - protein, 118 aa, Artificial Sequence
  Synthetic Sequence
EVQLLESGGGLVQPGESLRLSCAASGFTFSNYAMNWVRQAPGKGLEWVSGIVGGGGTSYYADSVRGRFTISRDNSKNTLYLQMNSLRAEDTAVYYCVKDWNTTMITERGQGTLVTVSS

SEQ ID NO: 18056 - protein, 8 aa, Artificial Sequence
  Synthetic Sequence
GFTFSNYA

SEQ ID NO: 18057 - protein, 8 aa, Artificial Sequence
  Synthetic Sequence
GFTFSSYA

SEQ ID NO: 18058 - protein, 8 aa, Artificial Sequence
  Synthetic Sequence
GFTFTNYA

SEQ ID NO: 18059 - protein, 8 aa, Artificial Sequence
  Synthetic Sequence
IIGSGATT

SEQ ID NO: 18060 - protein, 8 aa, Artificial Sequence
  Synthetic Sequence
ITGDGGST

SEQ ID NO: 18061 - protein, 8 aa, Artificial Sequence
  Synthetic Sequence
IIGSGGST

SEQ ID NO: 18062 - protein, 8 aa, Artificial Sequence
  Synthetic Sequence
ISGGGGST

SEQ ID NO: 18063 - protein, 8 aa, Artificial Sequence
  Synthetic Sequence
IVGGGGTS

SEQ ID NO: 18064 - protein, 11 aa, Artificial Sequence
  Synthetic Sequence
VKDWNTTMITE

SEQ ID NO: 18065 - protein, 25 aa, Artificial Sequence
  Synthetic Sequence
EVQLLESGGGLVQPGGSLTLSCAAS

SEQ ID NO: 18066 - protein, 25 aa, Artificial Sequence
  Synthetic Sequence
EVQLLESGGGLVQPGGSLRLSCAAS

SEQ ID NO: 18067 - protein, 25 aa, Artificial Sequence
  Synthetic Sequence
EVQLLESGGGLAQPGGSLRLSCAAS

SEQ ID NO: 18068 - protein, 25 aa, Artificial Sequence
  Synthetic Sequence
EVQLLESGGGLVQPGRSLRLSCAAS

SEQ ID NO: 18069 - protein, 25 aa, Artificial Sequence
  Synthetic Sequence
EVQLLESGGGLVQPGESLRLSCAAS

SEQ ID NO: 18070 - protein, 17 aa, Artificial Sequence
  Synthetic Sequence
MNWVRQAPGKGLEWVSG

SEQ ID NO: 18071 - protein, 17 aa, Artificial Sequence
  Synthetic Sequence
MTWIRQAPGKGLEWVSG

SEQ ID NO: 18072 - protein, 17 aa, Artificial Sequence
  Synthetic Sequence
MNWVRQAPGKGLEWVAG

SEQ ID NO: 18073 - protein, 38 aa, Artificial Sequence
  Synthetic Sequence
YYADSVKGRFTISRDNSKNTLNLQMNSLRAEDTAIYYC

SEQ ID NO: 18074 - protein, 38 aa, Artificial Sequence
  Synthetic Sequence
FYADSVKGRFTISRDNSKNTLYLQMNSLRAEDTAVYYC

SEQ ID NO: 18075 - protein, 38 aa, Artificial Sequence
  Synthetic Sequence
YYADSVKGRFSISRDNSKNTLDLQMNSLRAEDTAVYYC

SEQ ID NO: 18076 - protein, 38 aa, Artificial Sequence
  Synthetic Sequence
YYADSVKGRFTISRDNSKNTVYLQMNSLRAEDTAVYYC

SEQ ID NO: 18077 - protein, 38 aa, Artificial Sequence
  Synthetic Sequence
YYADSVKGRFTISRDNSKNTLYLQMNSLRAEDTAVYYC

SEQ ID NO: 18078 - protein, 38 aa, Artificial Sequence
  Synthetic Sequence
YYADSVRGRFTISRDNSKNTLYLQMNSLRAEDTAVYYC

SEQ ID NO: 18079 - protein, 11 aa, Artificial Sequence
  Synthetic Sequence
RGQGTLVTVSS

SEQ ID NO: 18080 - protein, 11 aa, Artificial Sequence
  Synthetic Sequence
RGQGTLVTVSS
